US012221636B2

(12) United States Patent
Zhang et al.

(10) Patent No.: US 12,221,636 B2
(45) Date of Patent: Feb. 11, 2025

(54) SYSTEMS METHODS, AND COMPOSITIONS FOR TARGETED NUCLEIC ACID EDITING

(71) Applicants: THE BROAD INSTITUTE, INC., Cambridge, MA (US); MASSACHUSETTS INSTITUTE OF TECHNOLOGY, Cambridge, MA (US); PRESIDENT AND FELLOWS OF HARVARD COLLEGE, Cambridge, MA (US)

(72) Inventors: Feng Zhang, Cambridge, MA (US); Jonathan Gootenberg, Cambridge, MA (US); Omar Abudayyeh, Cambridge, MA (US)

(73) Assignees: THE BROAD INSTITUTE, INC., Cambridge, MA (US); MASSACHUSETTS INSTITUTE OF TECHNOLOGY, Cambridge, MA (US); PRESIDENT AND FELLOWS OF HARVARD COLLAGE, Cambridge, MA (US)

( * ) Notice: Subject to any disclaimer, the term of this patent is extended or adjusted under 35 U.S.C. 154(b) by 709 days.

(21) Appl. No.: 16/650,480

(22) PCT Filed: Oct. 4, 2018

(86) PCT No.: PCT/US2018/054469
§ 371 (c)(1),
(2) Date: Mar. 25, 2020

(87) PCT Pub. No.: WO2019/071048
PCT Pub. Date: Apr. 11, 2019

(65) Prior Publication Data
US 2021/0009972 A1    Jan. 14, 2021

Related U.S. Application Data

(60) Provisional application No. 62/568,313, filed on Oct. 4, 2017.

(51) Int. Cl.
*C12N 9/22*    (2006.01)
*C12N 9/78*    (2006.01)
*C12N 15/113*    (2010.01)
*C12N 15/86*    (2006.01)

(52) U.S. Cl.
CPC .............. *C12N 9/22* (2013.01); *C12N 9/78* (2013.01); *C12N 15/113* (2013.01); *C12N 15/86* (2013.01); *C12Y 305/04004* (2013.01); *C12Y 305/04005* (2013.01); *C12N 2310/20* (2017.05); *C12N 2800/80* (2013.01)

(58) Field of Classification Search
CPC ...................................................... C12N 9/22
See application file for complete search history.

(56) References Cited

U.S. PATENT DOCUMENTS

| 9,650,627 B1 | 5/2017 | Rosenthal et al. |
| 2015/0165054 A1 | 6/2015 | Liu et al. |
| 2018/0334685 A1* | 11/2018 | Yeo ........................ C12N 15/85 |
| 2020/0131488 A1* | 4/2020 | Cox ........................ C12N 15/86 |
| 2020/0248169 A1* | 8/2020 | Zhang .................... C12N 15/10 |
| 2020/0283755 A1* | 9/2020 | Zhang .................. C12N 15/102 |
| 2020/0291382 A1* | 9/2020 | Zhang ...................... C12N 9/78 |
| 2021/0071158 A1* | 3/2021 | Zhang .................... C12N 15/11 |
| 2021/0093667 A1* | 4/2021 | Zhang .................. C12Y 305/04 |

FOREIGN PATENT DOCUMENTS

| CN | 110799645 A | 2/2020 |
| CN | 111328290 A | 6/2020 |
| JP | 2017500035 A | 1/2017 |
| WO | 2014/093622 A2 | 6/2014 |
| WO | 2015089406 A1 | 6/2015 |
| WO | 2015/184016 A2 | 12/2015 |
| WO | 2016/097212 A1 | 6/2016 |
| WO | 2016/205759 A1 | 12/2016 |
| WO | 2017/031360 A1 | 2/2017 |
| WO | 2017/070605 A1 | 4/2017 |
| WO | 2017/219027 A1 | 12/2017 |
| WO | 2019/071048 A1 | 4/2019 |
| WO | 2019/084062 A1 | 5/2019 |
| WO | 2019/084063 A1 | 5/2019 |

OTHER PUBLICATIONS

Folz et al., "Substrate Specificity of Eukaryotic Signal Peptidase", J. Biol. Chem., 1988, vol. 263, No. 4, pp. 2070-2078.*
Airaksinen et al., "Modified Base Compositions at Degenerate Positions of a Mutagenic Oligonucleotide Enhance Randomness in Site-Saturation Mutagenesis", Nucleic Acids Research, 1998, vol. 26, No. 2, pp. 576-581.*
Gerber, A.P., et al., "RNA editing by base deamination: more enzymes, more targets, new mysteries," Trends in Biochemical Sciences, Elsevier, Amsterdam, NL, vol. 26, No. 6, Jun. 1, 2001, all enclosed pages cited.
Zhang, D., et al., "A novel RNA-guided RNA-targeting CRISPR tool," Science China Life Sciences, Zhongguo Kexue Zazhishe, China, vol. 59, No. 8, Jul. 19, 2016, all enclosed pages cite.
Extended Search Report and Written Opinion for corresponding European application No. 18863854.8 mailed Oct. 27, 2021, all enclosed pages cited.
Zong et al., "Precise Base Editing in Rice, Wheat and Maize with a Cas9-cytidine Deaminase Fusion", Nature Biotechnology, vol. 35, No. 5, Feb. 27, 2017, 5 pages.
Wang et al., "A Phenotypic Screen for Functional Mutants of Human Adenosine Deaminase Acting on RNA 1", ACS Chemical Biology, vol. 10, No. 11, Nov. 20, 2015, 20 pages.
Wang et al., "Genetic Screens in Human Cells Using the CRISPR/Cas9 System", Science, vol. 343, No. 6166, Jan. 3, 2014, 12 pages.

(Continued)

*Primary Examiner* — Suzanne M Noakes
(74) *Attorney, Agent, or Firm* — F. Brent Nix, Esq.; Johnson, Marcou, Isaacs & Nix, LLC

(57) ABSTRACT

The invention provides for systems, methods, and compositions for targeting and editing nucleic acids. In particular, the invention provides non-naturally occurring or engineered RNA-targeting systems comprising a RNA-targeting Cas13 protein, at least one guide molecule, and at least one adenosine deaminase protein or catalytic domain thereof.

37 Claims, 116 Drawing Sheets

Specification includes a Sequence Listing.

(56) References Cited

OTHER PUBLICATIONS

Wang et al., "One-Step Generation of Mice Carrying Mutations in Multiple Genes by CRISPR/Cas-Mediated Genome Engineering", Cell, vol. 153, No. 4, May 9, 2013, 13 pages.
Wang et al., "Probing RNA Recognition by Human ADAR2 using a High-throughput Mutagenesis Method", Nucleic Acids Research, vol. 44, No. 20, Nov. 16, 2016, 9872-9880.
Wettengel et al., "Harnessing Human ADAR2 for RNA Repair—Recoding a PINK1 Mutation Rescues Mitophagy", Nucleic Acids Research, vol. 45, No. 5, Oct. 7, 2016, 2797-2808.
Wong et al., "Substrate Recognition by ADAR1 and ADAR2", RNA, vol. 7, No. 6, Jun. 2001, 846-858.
Wu et al., "Genome-Wide Binding of the CRISPR Endonuclease Cas9 in Mammalian Cells", Nature Biotechnology, vol. 32, No. 7, Jul. 2014, 670-676.
Xu et al., "Sequence Determinants of Improved CRISPR SgRNA Design", Genome Research, vol. 25, No. 8, Aug. 2015, 11 pages.
Yang et al., "Engineering and Optimizing Deaminase Fusions for Genome Editing", Nature Communication, vol. 7, Issue 13330,, Nov. 2, 2016, 11 pages.
Zetsche et al., "A Split-Cas9 Architecture for Inducible Genome Editing and Transcription Modulation", Nature Biotechnology, vol. 33, No. 2, Feb. 2015, 139-142.
Zetsche et al., "Cpf1 is a Single RNA-Guided Endonuclease of a Class 2 CRISPR-Cas System", Cell, vol. 163, No. 3, Oct. 22, 2015, 759-771.
Zheng et al., "DNA Editing in DNA/RNA Hybrids by Adenosine Deaminases that Act on RNA", Nucleic Acids Research, vol. 45, No. 6, Jan. 28, 2017, 3369-3377.
International Preliminary Report on Patentability issued in International Application No. PCT/US2018/054469, mailed on Apr. 16, 2020, 18 pages.
International Search Report and Written Opinion issued in International Application No. PCT/US2018/054469, mailed on Jan. 10, 2019, 24 pages.
Abudayyeh et al., "C2C2 is a Single-Component Programmable RNA-Guided RNA-Targeting CRISPR Effector", Science, vol. 353, No. 6299, Aug. 5, 2016, 23 pages.
Abudayyeh et al., "RNA Targeting with CRISPR-Cas13a", Nature, vol. 550, No. 7675, Oct. 4, 2017, 30 pages.
Canver et al., "BCL11A Enhancer Dissection by Cas9-Mediated In Situ Saturating Mutagenesis", Nature, vol. 527, No. 7577, Nov. 12, 2015, 23 pages.
Chen et al., "Genome-Wide CRISPR Screen in a Mouse Model of Tumor Growth and Metastasis", Cell, vol. 160, No. 6, Mar. 12, 2015, 28 pages.
Chen et al., "Targeted Activation of Diverse CRISPR-Cas Systems for Mammalian Genome Editing via Proximal CRISPR Targeting", Nature Communications, vol. 8, Article 14958, Apr. 7, 2017, 12 pages.
Cong et al., "Multiplex Genome Engineering Using CRISPR/Cas Systems", Science, vol. 339, No. 6121, Feb. 15, 2013, 819-823.
Doench et al., "Rational Design of Highly Active SgRNAs for CRISPR-Cas9-Mediated Gene Inactivation", Nature Biotechnology, vol. 32, No. 12, Dec. 2014, 17 pages.
Fukuda et al., "Construction of a Guide-RNA for Site-Directed RNA Mutagenesis Utilising Intracellular A-To-I RNA Editing", Scientific Reports, vol. 7, No. 41478, Feb. 2017, 13 pages.
Gao et al., "Engineered Cpf1 Enzymes with Altered PAM Specificities", Nature Biotechnology, vol. 35, No. 8, Dec. 4, 2016, 17 pages.
Gootenberg et al., "Nucleic Acid Detection with CRISPR-Cas13a/C2c2", Science, vol. 356, No. 6336, Apr. 13, 2017, 438-442.
Gootenberg et al., "Nucleic Acid Detection with CRISPR-Cas13a/C2c2", Science, vol. 356, No. 6336, Apr. 28, 2017, 6 pages.
Hsu et al., "Development and Applications of CRISPR-Cas9 for Genome Engineering", Cell, vol. 157, No. 6, Jun. 5, 2014, 34 pages.
Hsu et al., "DNA Targeting Specificity of RNA-Guided Cas9 Nucleases", Nature Biotechnology, vol. 31, No. 9, Sep. 2013, 827-832.
Hur et al., "Targeted Mutagenesis in Mice by Electroporation of Cpf1 Ribonucleoproteins", Nature Biotechnology, vol. 34, No. 8, Aug. 2016, 807-808.
Jiang et al., "RNA-Guided Editing of Bacterial Genomes Using CRISPR-Cas Systems", Nature Biotechnology, vol. 31, No. 3, Mar. 2013, 233-239.
Kim et al., "A Guide to Genome Engineering with Programmable Nucleases", Nature Reviews Genetics, vol. 15, May 2014, 321-334.
Kim et al., "Genome-Wide Analysis Reveals Specificities of Cpf1 Endonucleases in Human Cells", Nature Biotechnology, vol. 34, No. 8, Aug. 2016, 863-888.
Kim et al., "Increasing the Genome-Targeting Scope and Precision of Base Editing with Engineered Cas9-Cytidine Deaminase Fusions", Nature Biotechnology, vol. 35, No. 4, Feb. 13, 2017, 371-376.
Komor et al., "CRISPR-Based Technologies for the Manipulation of Eukaryotic Genomes", Cell, vol. 168, No. (1-2), Jan. 12, 2017, 34 pages.
Komor et al., "Programmable Editing of a Target Base in Genomic DNA without Double-Stranded DNA Cleavage", Nature, vol. 533, No. 7603, May 19, 2016, 25 pages.
Konermann et al., "Genome-Scale Transcriptional Activation by an Engineered CRISPR-Cas9 Complex", Nature, vol. 517, No. 7536, Jan. 29, 2015, 583-588.
Konermann et al., "Optical Control of Mammalian Endogenous Transcription and Epigenetic States", Nature, vol. 500, No. 7463, Aug. 22, 2013, 18 pages.
Kuttan et al., "Mechanistic Insights into Editing-Site Specificity of ADARs", Proceedings of the National Academy of Sciences, USA, vol. 48, 2012, E3295-E3304.
Mali et al., "RNA-Guided Human Genome Engineering via Cas9", Science, vol. 339, No. 6121, Feb. 15, 2013, 8 pages.
Matthews et al., "Structures of Human ADAR2 Bound to dsRNA Reveal Base-Flipping Mechanism and Basis for Site Selectivity", Nature Structural & Molecular Biology, vol. 23, No. 5, May 2016, 426-433.
Montiel-Gonzalez et al., "An Efficient System for Selectively Altering Genetic Information within mRNAs", Nucleic Acids Research, vol. 44, No. 21, Aug. 23, 2016, 12 pages.
Montiel-Gonzalez et al., "Correction of Mutations within the Cystic Fibrosis Transmembrane Conductance Regulator by Site-Directed RNA Editing", Proceedings of the National Academy of Sciences, vol. 110, No. 45, Nov. 5, 2013, 11 pages.
Nishida et al., "Targeted Nucleotide Editing Using Hybrid Prokaryotic and Vertebrate Adaptive Immune Systems", Science, vol. 353, No. 6305, Sep. 16, 2016, 10 pages.
Nishikura, Kazuko, "Functions and Regulation of RNA Editing by ADAR Deaminases", Annual Review of Biochemistry, vol. 79, 2010, 33 pages.
Nishimasu et al., "Crystal Structure of Cas9 in Complex with Guide RNA and Target DNA", Cell, vol. 156, No. 5, Feb. 27, 2014, 25 pages.
Nishimasu et al., "Crystal Structure of *Staphylococcus aureus* Cas9", Cell, vol. 162, Aug. 27, 2015, 1113-1126.
Parnas et al., "A Genome-Wide CRISPR Screen in Primary Immune Cells to Dissect Regulatory Networks", Cell, vol. 162, No. 3, Jul. 30, 2015, 24 pages.
Platt et al., "CRISPR-Cas9 Knockin Mice for Genome Editing and Cancer Modeling", Cell, vol. 159, No. 2, Oct. 9, 2014, 31 pages.
Port et al., "Expansion of the CRISPR Toolbox in an Animal with tRNA-Flanked Cas9 and Cpf1 gRNAs", Biorxiv Reprint, Port and Bullock, Mar. 31, 2016, 10 pages.
Ramanan et al., "CRISPR/Cas9 Cleavage of Viral DNA Efficiently Suppresses Hepatitis B Virus", Scientific Reports, vol. 5, Article No. 10833, Jun. 2, 2015, 9 pages.
Ran et al., "Double Nicking by RNA-Guided CRISPR Cas9 for Enhanced Genome Editing Specificity", Cell, vol. 154, No. 6, Sep. 12, 2013, 19 pages.
Ran et al., "Genome Engineering Using the CRISPR-Cas9 System", Nature Protocols, vol. 8, No. 11, Nov. 2013, 49 pages.

(56) References Cited

OTHER PUBLICATIONS

Ran et al., "In Vivo Genome Editing using *Staphylococcus aureus* Cas9", Nature, vol. 520, No. 7546, Apr. 1, 2015, 30 pages.
Schneider et al., "Optimal Guidernas for Re-Directing Deaminase Activity of hADAR1 and hADAR2 in Trans", Nucleic Acids Research, vol. 42, Issue 10, Apr. 17, 2014, 9 pages.
Shalem et al., "Genome-Scale CRISPR-Cas9 Knockout Screening in Human Cells", Science, vol. 343, No. 6166, Jan. 3, 2014, 84-87.
Shalem et al., "High-Throughput Functional Genomics Using CRISPR-Cas9", Nature Reviews, vol. 16, May 2015, 299-311.
Shimatani et al., "Targeted Base Editing in Rice and Tomato Using a Crispr-cas9 Cytidine Deaminase Fusion", Nature Biotechnology, vol. 35, No. 5, Mar. 27, 2017, 5 pages.
Shmakov et al., "Discovery and Functional Characterization of Diverse Class 2 CRISPR-Cas Systems", Molecular Cell, vol. 60, No. 3, Nov. 5, 2015, 385-397.
Shmakov et al., "Diversity and Evolution of Class 2 CRISPR-Cas Systems", Nature Reviews Microbiology, vol. 15, No. 3, Mar. 2017, 30 pages.
Slaymaker et al., "Rationally Engineered Cas9 Nucleases with Improved Specificity", Science, vol. 351, No. 6268, Jan. 1, 2016, 84-88.
Smargon et al., "Cas 13B is a Type VI-B CRISPR-Associated RNA-Guided RNAse Differentially Regulated by Accessory Proteins Csx27 and Csx28", Molecular Cell, vol. 65, No. 4, Feb. 16, 2017, 30 pages.
Swiech et al., "In Vivo Interrogation of Gene Function in the Mammalian Brain Using CRISPR-Cas9", Nature Biotechnology, vol. 33, No. 1, Jan. 2015, 102-106.
Tsai et al., "Dimeric CRISPR RNA-Guided FokI Nucleases for Highly Specific Genome Editing", Nature Biotechnology, vol. 32, No. 6, Jun. 2014, 569-576.
Office Action from corresponding Japanese application No. 2020-519386 mailed Nov. 1, 2022, all enclosed pages cited.
Office Action from corresponding Korean application No. 10-2020-7010211 mailed Nov. 9, 2023, all enclosed pages cited.
Office Action from corresponding Japanese application No. 2020-519386 mailed Jun. 27, 2023, all enclosed pages cited.
Office Action from corresponding Chinese application No. 201880078370.3 mailed Aug. 7, 2023, all enclosed pages cited.
Search Report from corresponding Chinese application No. 201880078370.3 mailed Aug. 7, 2023, all enclosed pages cited.
Office Action from corresponding Canadian application No. 3,077,086 mailed Aug. 24, 2023, all enclosed pages cited.
Office Action from corresponding Japanese application No. 2020-519386 mailed Jan. 9, 2024, all enclosed pages cited.
Office Action from corresponding Chinese application No. 201880078370.3 mailed Jan. 26, 2024, all enclosed pages cited.
Search Report from corresponding Chinese application No. 201880078370.3 mailed Jan. 26, 2024, all enclosed pages cited.
Office Action from corresponding Australian application No. 2018346527 mailed Mar. 15, 2024, all enclosed pages cited.
Office Action from corresponding Korean application No. 10-2020-7010211 mailed Aug. 28, 2024, all enclosed pages cited.
Office Action from corresponding Chinese application No. 201880078370.3 mailed Aug. 28, 2024, all enclosed pages cited.
Office Action from corresponding Chinese application No. 201880078370.3 mailed May 18, 2024, all enclosed pages cited.
Office Action from corresponding Australian application No. 2018346527 mailed Oct. 14, 2024, all enclosed pages cited.

\* cited by examiner

| ADAR Name | Protein Sequence |
|---|---|
| Homo sapiens_ADAR2_E_Q_Mutant (SEQ ID NO : 650) | QLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGQGTIPVRSNASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLT* |
| Homo sapiens_ADAR1_E_Q_Mutant (SEQ ID NO : 651) | SLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGQGTIPVESSDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNF |
| Octopus vulgaris_ADAR1_E_Q_Mutant (SEQ ID NO : 652) | SVGTGNRCLTGDHLSLEGNSVNDSHAEMITRRGFLRYLYRHLLEYDAEVPNDLFEKGERSICRIKTNITFHLYISTAPCGDGALFSPRDTDSSNAKMEEENKHIHNPTFSSSVQGLLRTKVEGGQGTIPIDADFTEQTWDGIQRGERLRTMSCSDKICRWNVVGLQGALLSHFIEPIYLDSLTGYLYDHGHLARAVCCRIERGEASVNQLLPEGYRLNHPWLGRVTACDPPRETQKTKSLSINWCYDDEKSEVLDGTAGICYTAIEKNLFSRLTKHNLYEEFKRVCRKFDRNDLLTAPSYNKAKMMATPFQTAKNVMLKKLKENNCGTWVSKPIEEEMF |
| Sepia_ADAR1_E_Q_Mutant (SEQ ID NO : 653) | SVGTGNRCLTGDRLSLEGNSVNDSHAEMVTRRGFLRYLYKHLLEYDPEKPHDLFEKGERSLCRIKTNITFHLYISTAPCGDGALFSPRDTDSSNVKVDEENKHVHNPTFSSSVQGLLRTKVEGGQGTIPIDADFTEQTWDGIQRGERLRTMSCSDKICRWNVVGLQGALLSHFVEPIYLESLTGYLYDHGHLARAVCCRIERGEASVNQLLPEGYRLNHPWLGRVTACDPPRETQKTKSLSINWCYDDEKSEVLDGTAGICYTAIEKNLFSRLTKHSLYEEFKKVCQKFEREDLLNVTSYNKAKMMAIPFQTAKNVMLKKLKENNCGTWVSKPIEEEMF |

FIG. 4

| | |
|---|---|
| Octopus vulgaris_ADAR2_E_Q_Mutant (SEQ ID NO : 654) | GIGTGTKCINGEHMSDRGFGVNDCHAEIIARRCFLRYIYDQLELH LSDNSDVRNSSIFELRDKGGYQLKENIQFHLYISTAPCGDARIFSP HGQDVETGDRHPNRKARGQLRTKIESGQGTIPVRTSGVIQTWDG VLEGERLLTMSCSDKIARWNVLGIQGSLLSHFMNPIYLESIILGSL YHSDHLSRAMYSRISIIENLPEPFHLNRPFLSGISSPESRQPGKAPN FGINWRKEDETFEVINAMTGRVEGGSVSRICKQALFGRFMSLYG KLSSLTGQSVTTRPTHYSDAKAAVMEYQLAKQCVFQAFQKAGL GNWVQKPIEQDQF |
| Sepia_ADAR2_E_Q_Mutant(SEQ ID NO : 655) | GIGTGTKCINGEYMNDRGFAVNDCHAEIIARRCFLRFIYDQLEMH LSEDPEVRGQSVFELRDGGGYKLKPNIHFHLYISTAPCGDARIFSP HGQDVETGDRHPNRKARGQLRTKIESGQGTIPVRSSGFIQTWDG VLEGERLLTMSCSDKIARWNVLGIQGALLCHFMHPIYLESIILGSL YHSDHLSRAVYCRIASIENLPDLFQLNRPFLSGISSPESRQPGKAP NFGINWRRNDDTFEVINAMTGRVEGGNMSRICKQALFDRFMNL YGRLSSLTGQSVTTRPTLYSEAKAAVMEYQLAKQCVFQAFQKA GLGNWVQKPIEQDQF |
| Doryteusthis opalescens_ADAR2_E_Q_Mutant(SEQ ID NO : 656) | GIGTGTKCINGEYMNDRGFAVNDCHAEIIARRCFLRFIYDQLELH LSDNAEVRGQSIFELRDAGGYKLKPNIQFHLYISTAPCGDARIFSP HGQDVETGDRHPNRKARGQLRTKIESGQGTIPVRSSGFIQTWDG VLEGERLLTMSCSDKIARWNVLGVQGALLCHFMHPIYLESIILGS LYHSDHLSRAVYCRIAAIENLPDLFRLNRPFLSGISSPESRQPGKA PNFGINWRRNDDSFEVINAMTGRVEGGSMSRICKQALFDRFMNL YGKLSSLTGQSVTTRPALYSEAKATVMEYQLAKQCVFQAFQKA GLGNWVQKPIEQDQF |

FIG. 4 (continued)

Targeted A is shown in red and underlined. On-target percent editing is in parentheses.

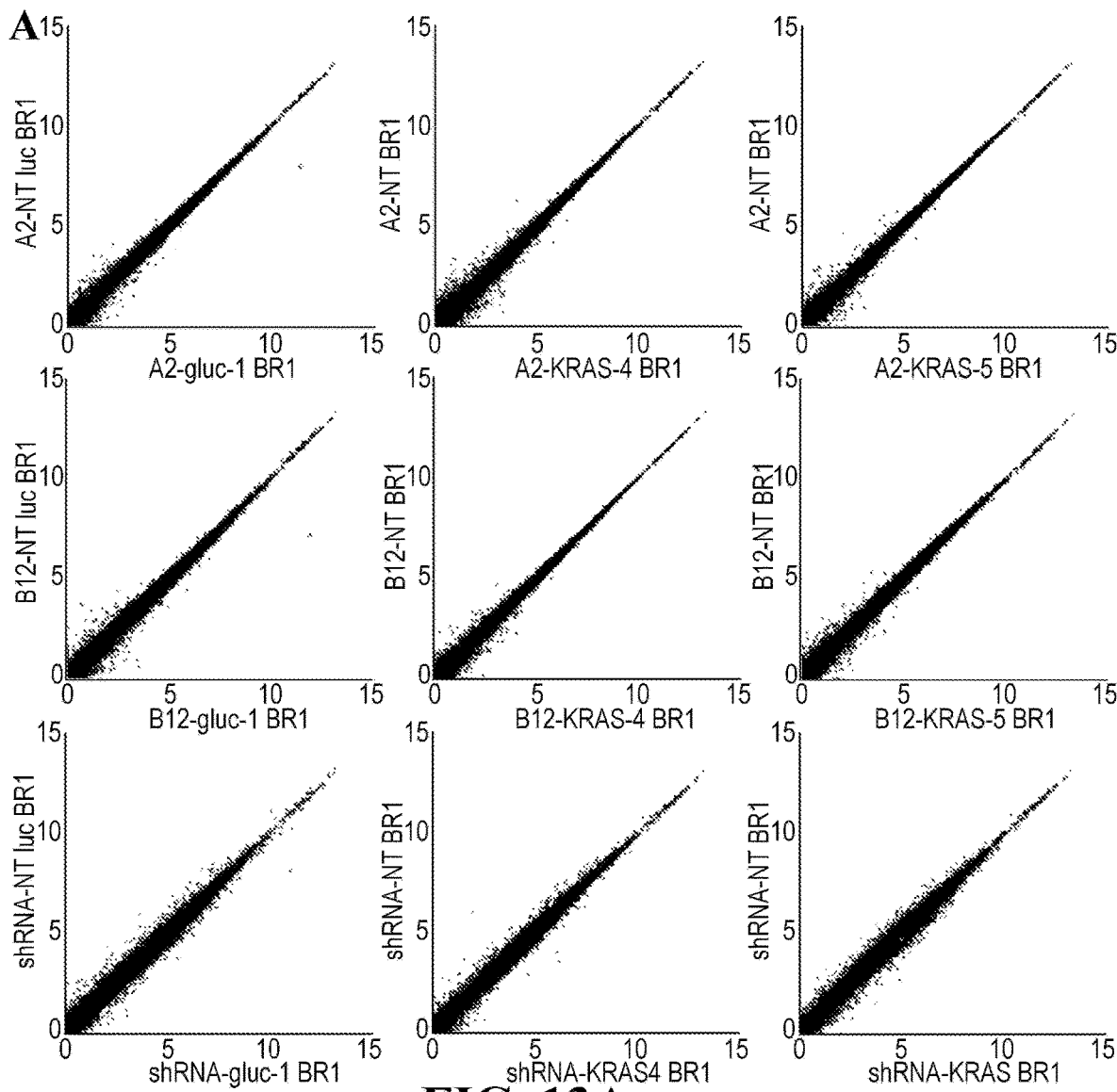
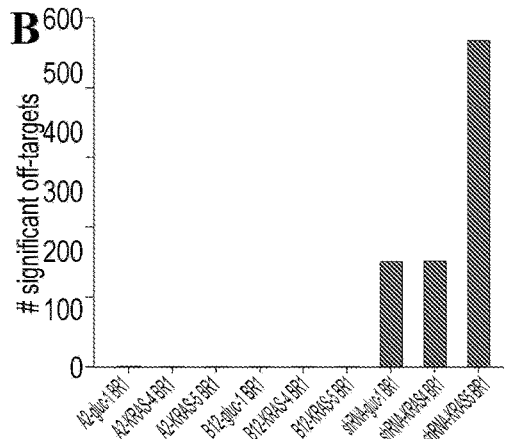
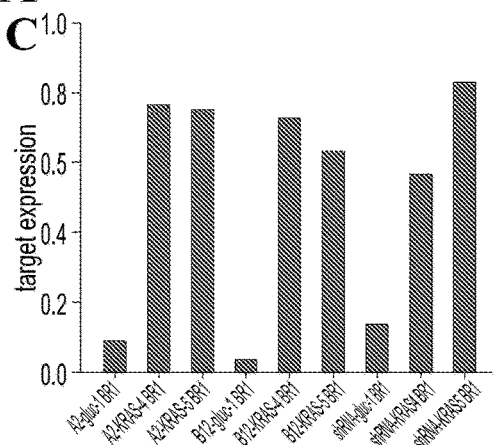
FIG. 13A
FIG. 13B
FIG. 13C

A

B

A

WT Cas13b target
TGGAGGTGCTCAAAGAGATGGAAGCCAATGCCCGGA all single mismatches
NGGAGGTGCTCAAAGAGATGGAAGCCAATGCCCGGA
TNGAGGTGCTCAAAGAGATGGAAGCCAATGCCCGGA
TGNAGGTGCTCAAAGAGATGGAAGCCAATGCCCGGA
TGGNGGTGCTCAAAGAGATGGAAGCCAATGCCCGGA
⋮
TGGNGGTGCTCAAAGAGATGGAAGCCAATGCCCGGN all double mismatches
NNGAGGTGCTCAAAGAGATGGAAGCCAATGCCCGGA
NGNAGGTGCTCAAAGAGATGGAAGCCAATGCCCGGA
NGGNGGTGCTCAAAGAGATGGAAGCCAATGCCCGGA
NGGANGTGCTCAAAGAGATGGAAGCCAATGCCCGGA
⋮
TGGAGGTGCTCAAAGAGATGGAAGCCAATGCCCGNN

FIG. 21A

Cas13a target
AGAGATGGAAGCCAATGCCCGGAAAGCTGGCTGC all single mismatches
[
NGAGATGGAAGCCAATGCCCGGAAAGCTGGCTGC
ANAGATGGAAGCCAATGCCCGGAAAGCTGGCTGC
AGNGATGGAAGCCAATGCCCGGAAAGCTGGCTGC
AGANATGGAAGCCAATGCCCGGAAAGCTGGCTGC
⋮
AGAGATGGAAGCCAATGCCCGGAAAGCTGGCTGN
]

all double mismatches
[
NNAGATGGAAGCCAATGCCCGGAAAGCTGGCTGC
NGNGATGGAAGCCAATGCCCGGAAAGCTGGCTGC
NGANATGGAAGCCAATGCCCGGAAAGCTGGCTGC
NGAGNTGGAAGCCAATGCCCGGAAAGCTGGCTGC
⋮
AGAGATGGAAGCCAATGCCCGGAAAGCTGGCTNN
]

| Guide | 3' start pos. | 5' start pos. | A-C pos. |
|---|---|---|---|
| 1 | 1 | 50 | 50 |
| 2 | 9 | 59 | 50 |
| 3 | 17 | 67 | 50 |
| 4 | 25 | 75 | 50 |
| 5 | 33 | 83 | 50 |
| 6 | 41 | 90 | 50 |
| 7 | 49 | 99 | 50 |
| NT | | | |

FIG. 27B

A 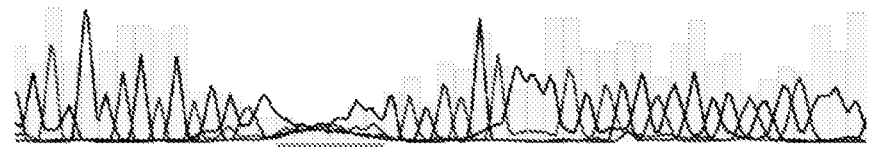
SEQ. ID NO.: 697
SEQ. ID NO.: 698
SEQ. ID NO.: 699
SEQ. ID NO.: 703
FIG. 33A
B 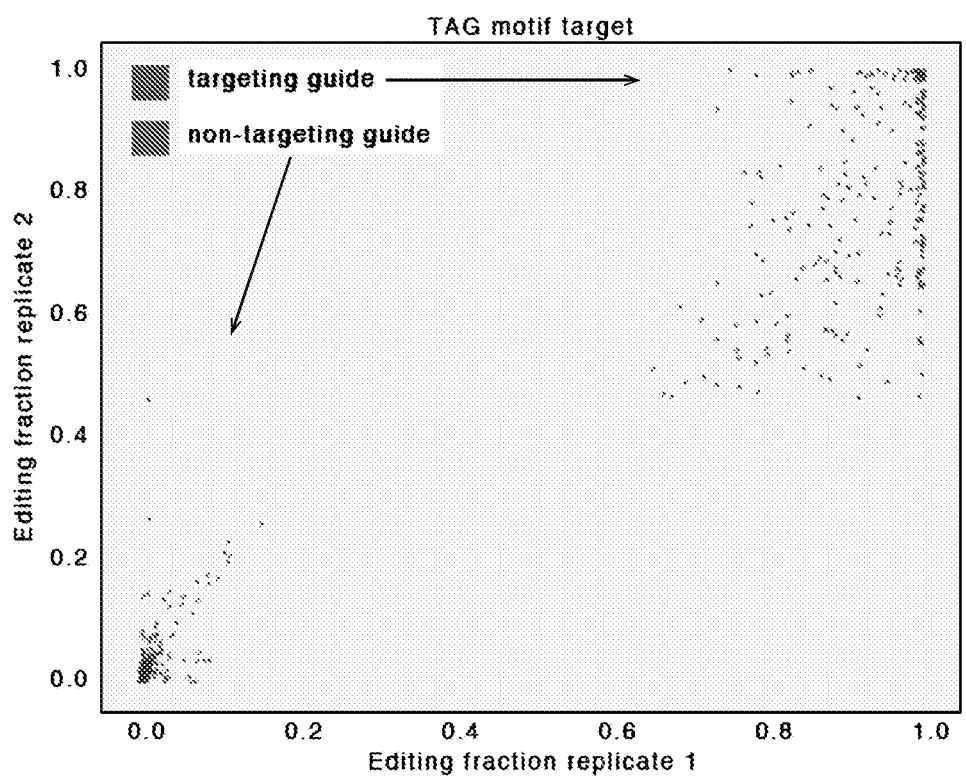
FIG. 33B

C

D

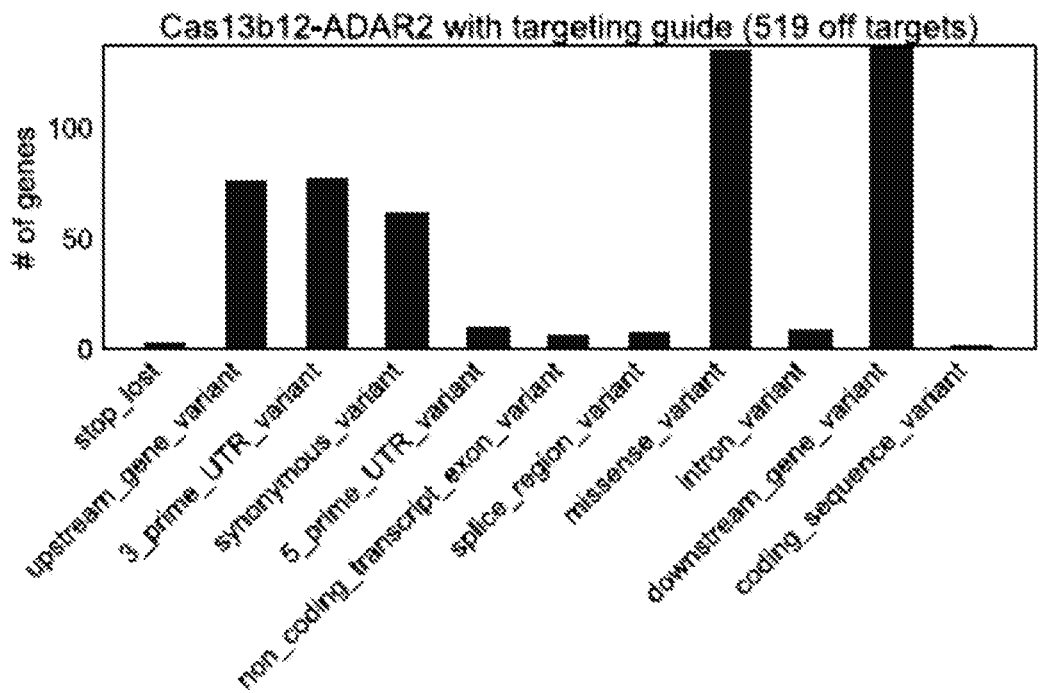
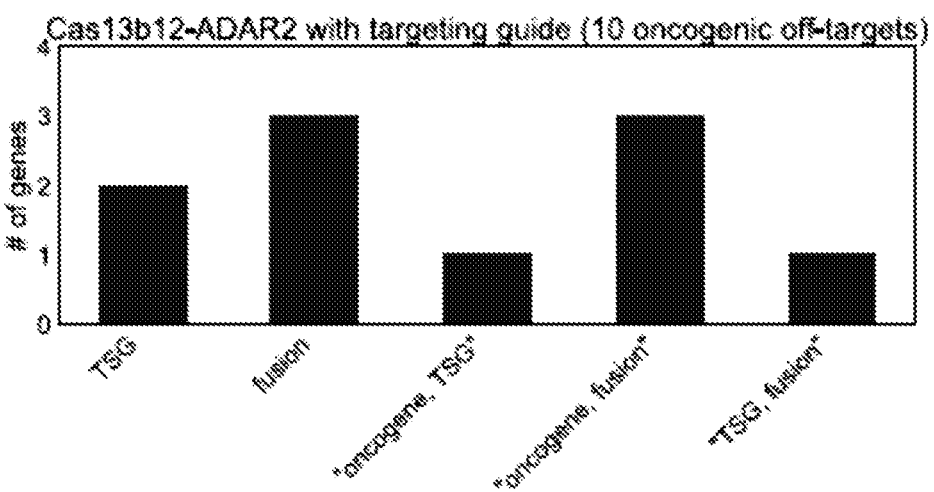
FIG. 37A

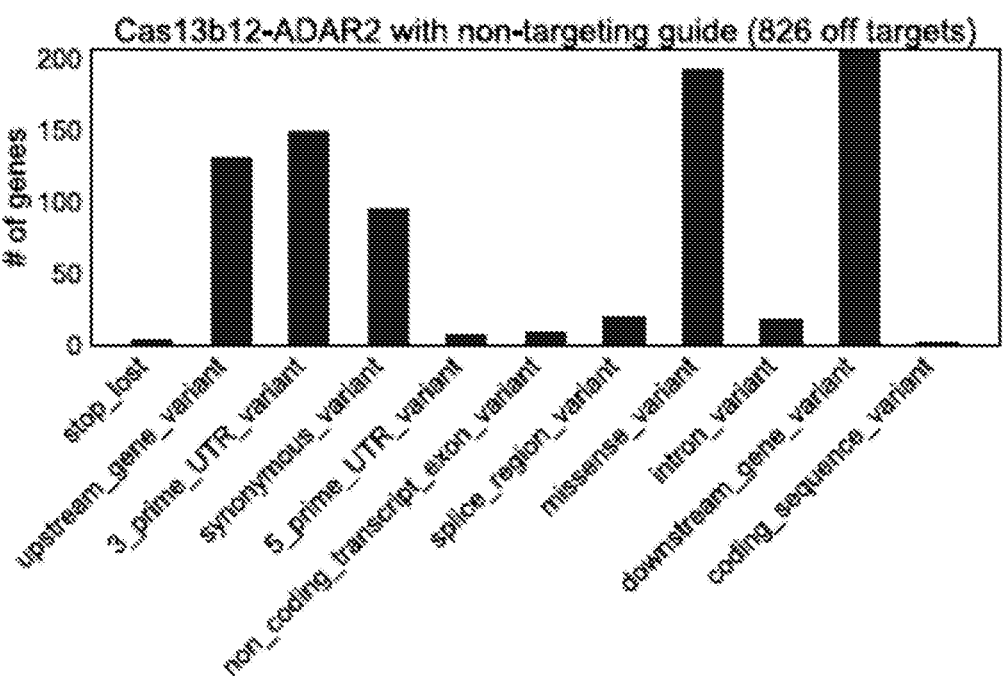
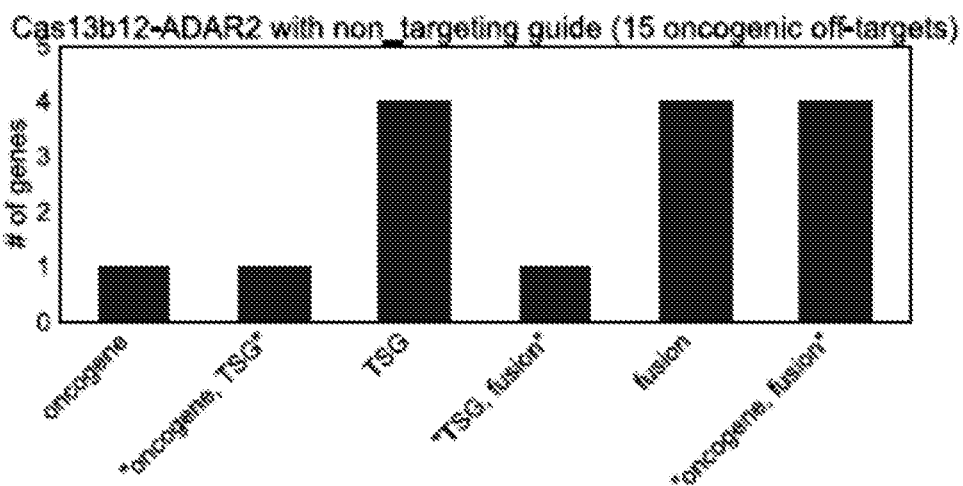
FIG. 37B

C

D

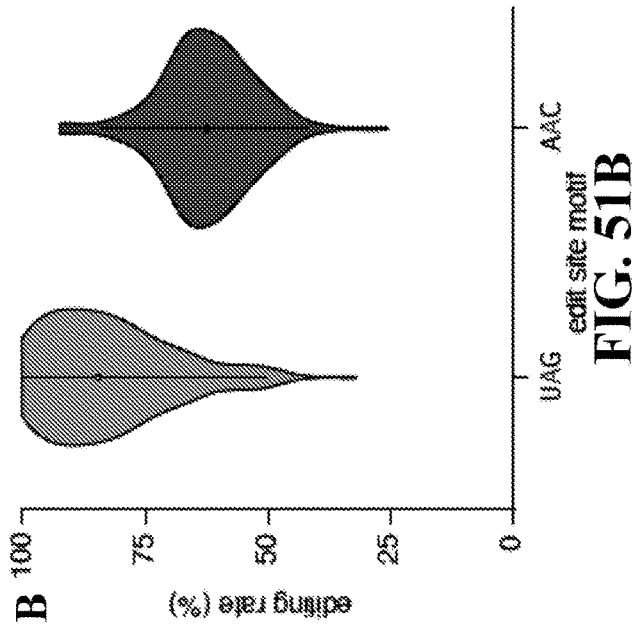
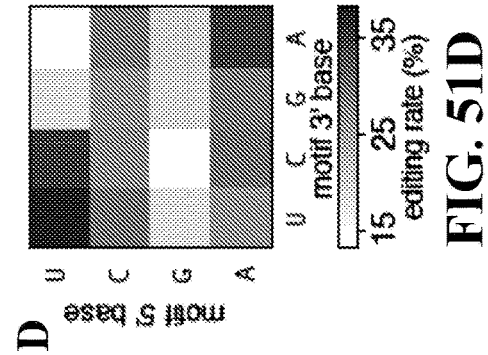
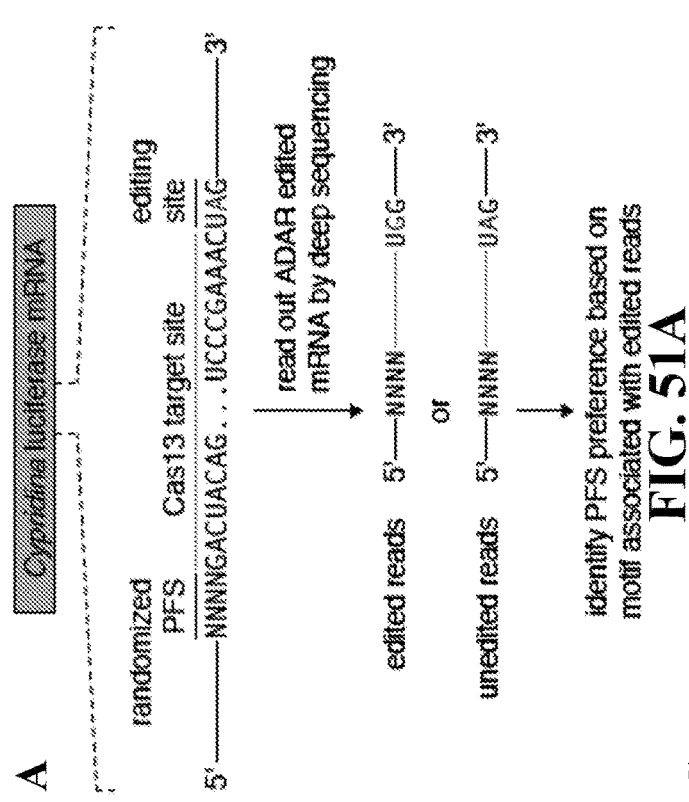
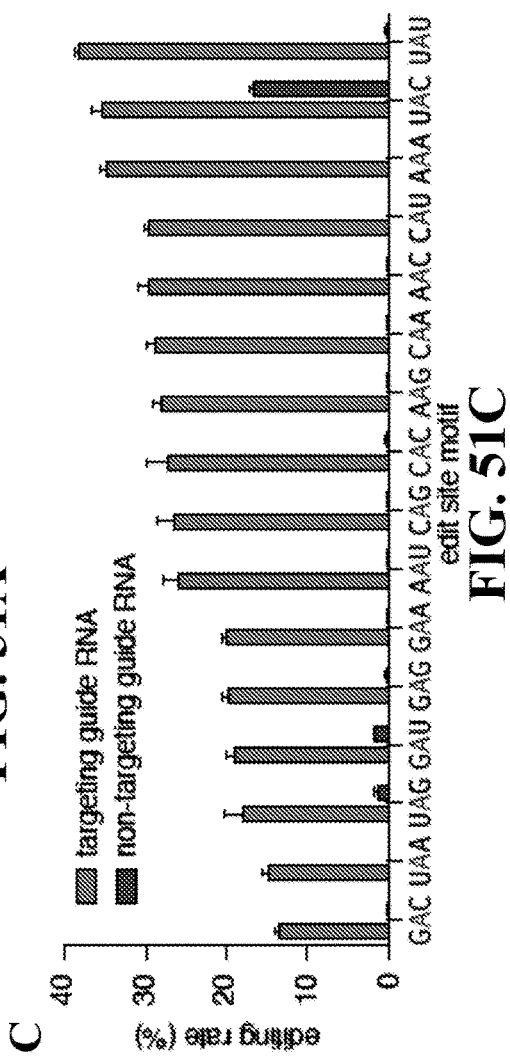
FIG. 51A
FIG. 51B
FIG. 51C
FIG. 51D

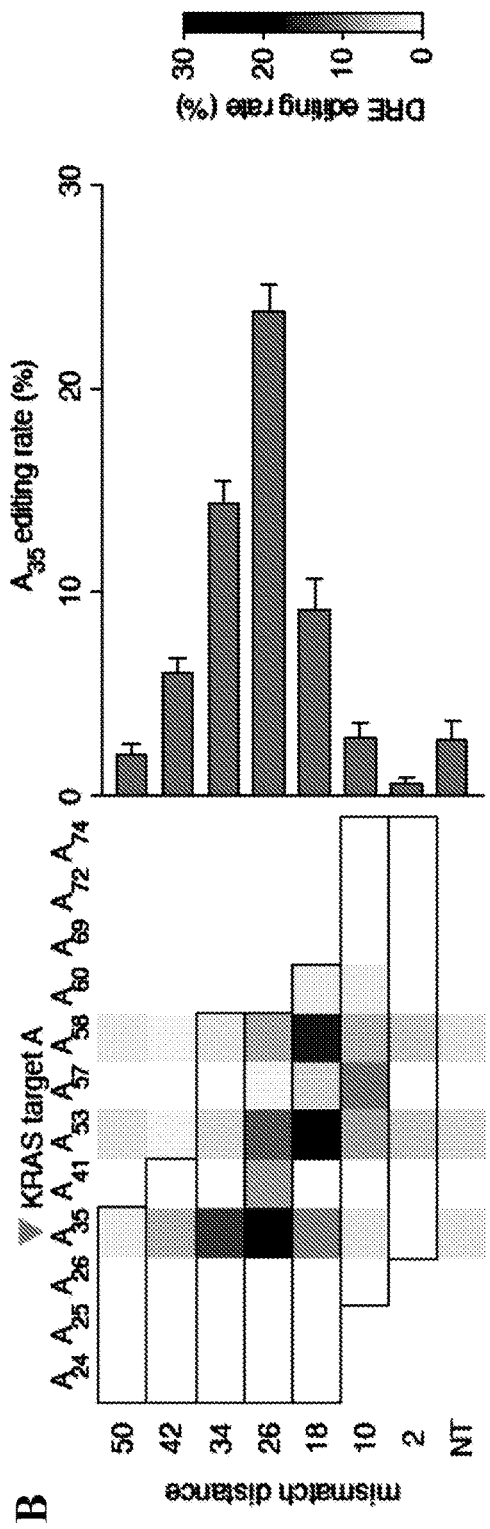
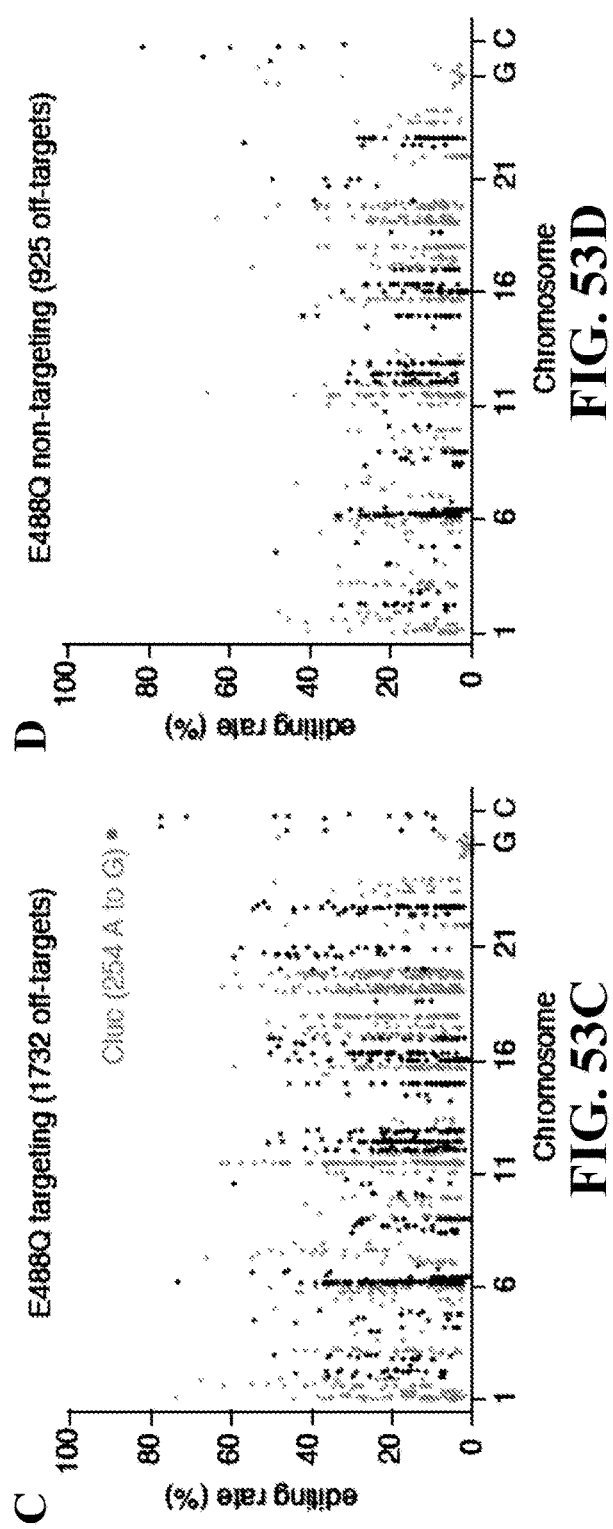
FIG. 53B
FIG. 53C
FIG. 53D

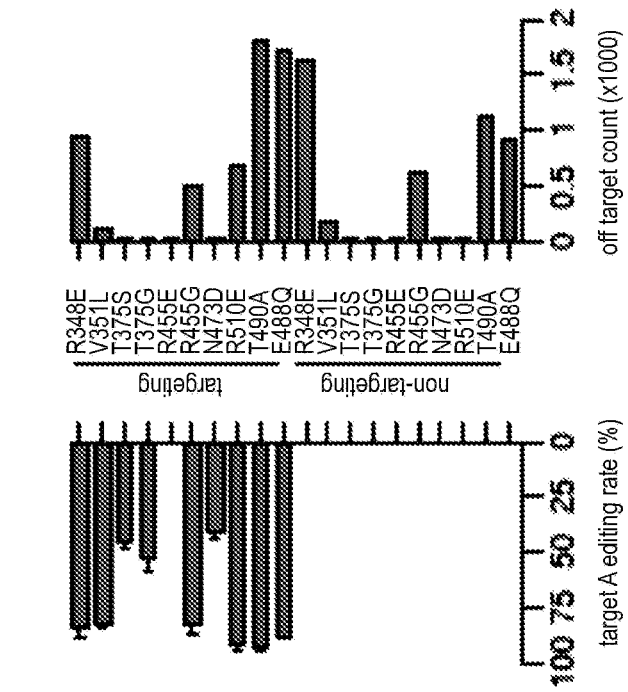
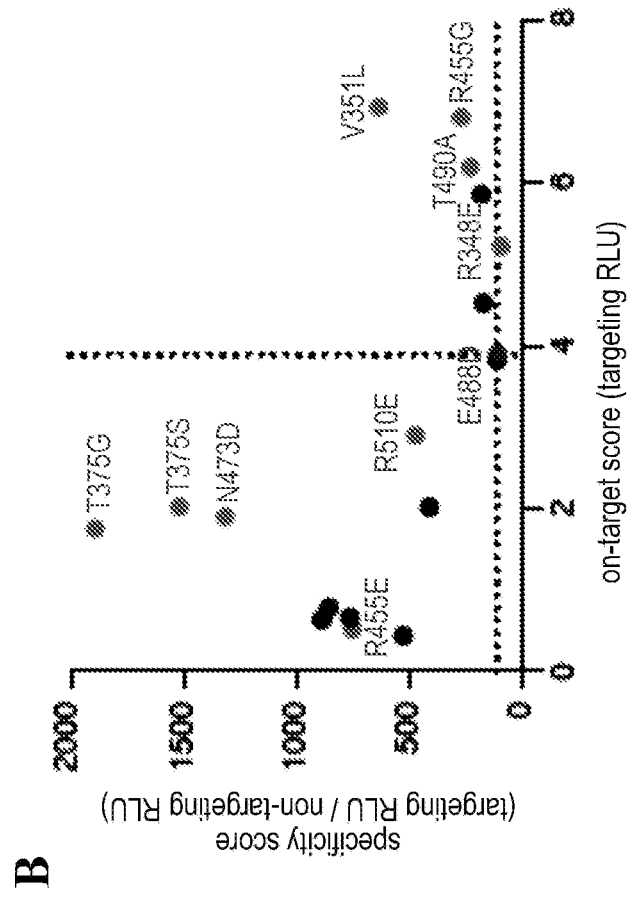
FIG. 54C
FIG. 54B

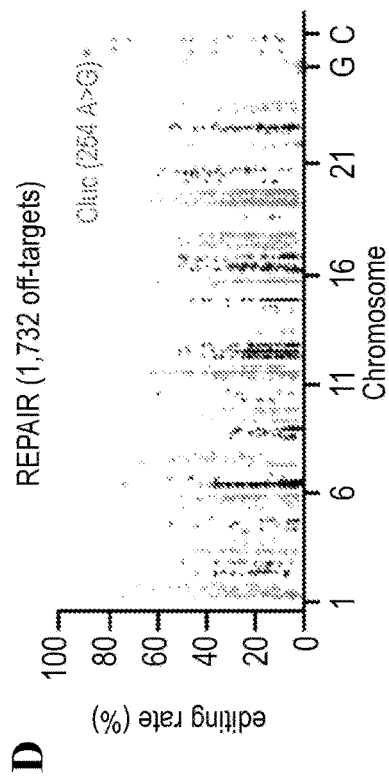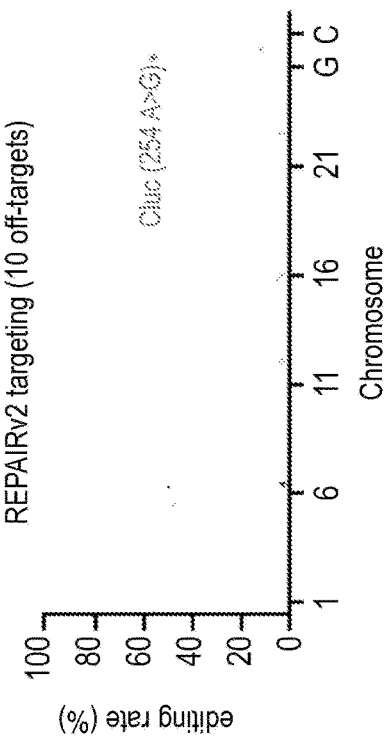
FIG. 54D
FIG. 54E

A PFS selection plasmid
5'- AUG NN UUGCCACCGACGACACCGUGAGGAUAAAUU NNNN ——— ... ——— -3'
          12                                              3456
5'-PFS    protospacer          3'-PFS    *bla*
VI-B plasmid
PFS selection plasmid
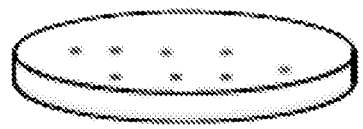
Plate on Cm + Amp → Enumerate cfu
→ Sequence for PFS
FIG. 55A

C

```
    5' PFS          PspCas13b target           3' PFS
    UGGAGGUGCUCAAAGAGAUGGAAGCCAAUGCCCGGA all single mismatches
 ⎡  NGGAGGUGCUCAAAGAGAUGGAAGCCAAUGCCCGGA
 ⎢  UNGAGGUGCUCAAAGAGAUGGAAGCCAAUGCCCGGA
 ⎢  UGNAGGUGCUCAAAGAGAUGGAAGCCAAUGCCCGGA
 ⎢  UGGNGGUGCUCAAAGAGAUGGAAGCCAAUGCCCGGA
 ⎢
 ⎢  UGGAGGUGCUCAAAGAGNUGGAAGCCAAUGCCCGGA
 ⎢
 ⎣  UGGAGGUGCUCAAAGAGAUGGAAGCCAAUGCCCGGN all double mismatches
 ⎡  NNGAGGUGCUCAAAGAGAUGGAAGCCAAUGCCCGGA
 ⎢  NGNAGGUGCUCAAAGAGAUGGAAGCCAAUGCCCGGA
 ⎢  NGGNGGUGCUCAAAGAGAUGGAAGCCAAUGCCCGGA
 ⎢  NGGANGUGCUCAAAGAGAUGGAAGCCAAUGCCCGGA
 ⎢
 ⎣  UGGAGGUGCUCAANGAGNUGGAAGCCAAUGCCCGGA
```

FIG. 56C

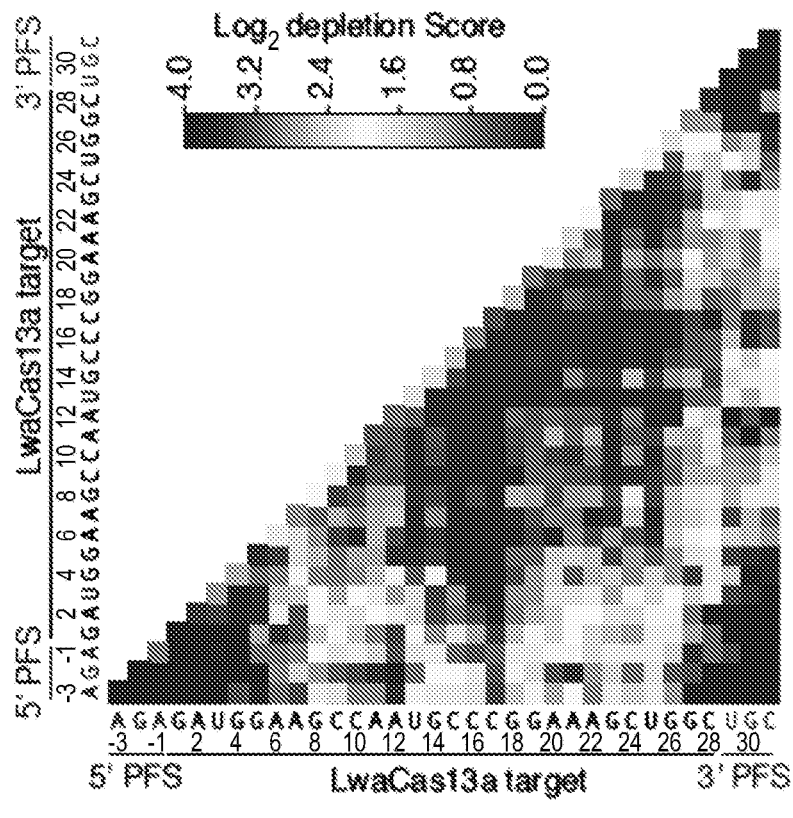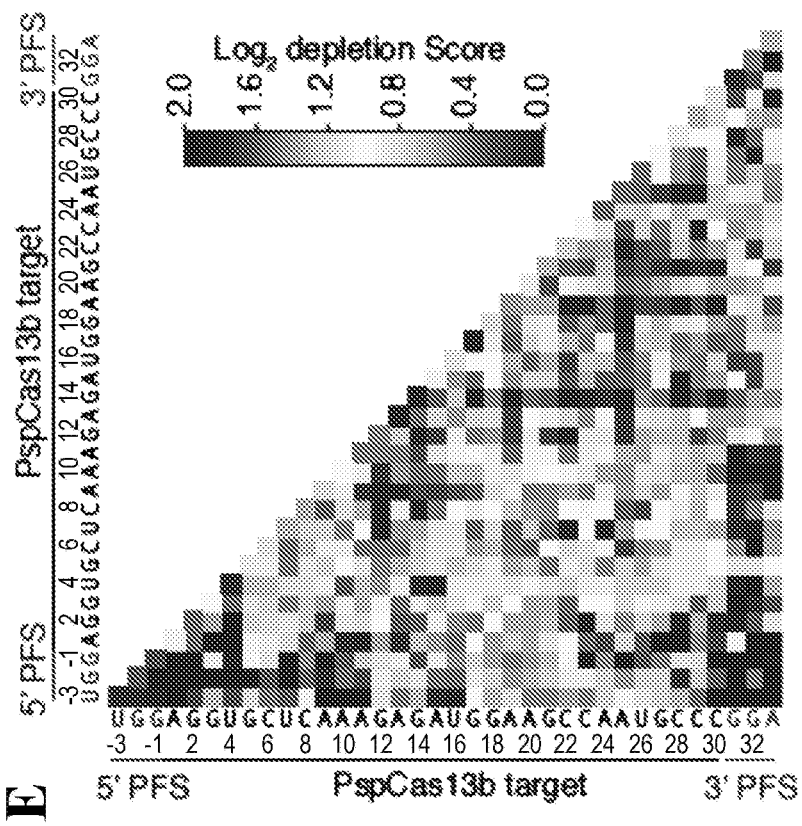
FIG. 56E

A
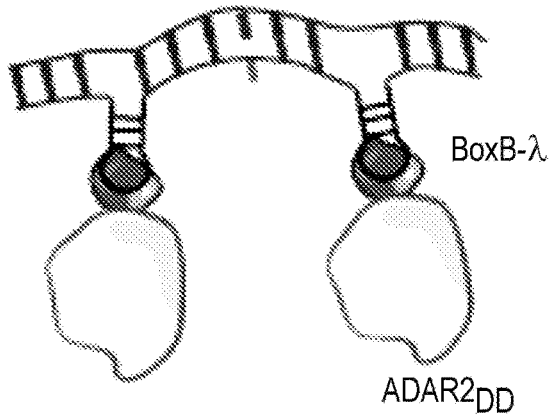
BoxB-based RNA targeting
BoxB-λ
ADAR2$_{DD}$
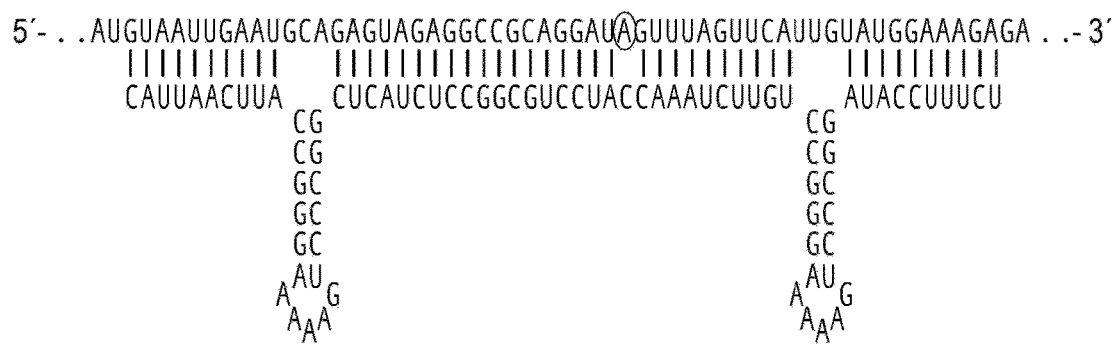
ADAR2 RNA targeting
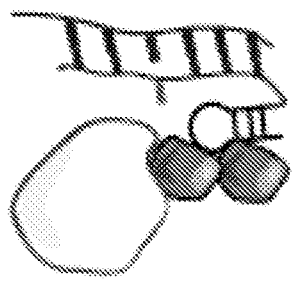
Full length ADAR2
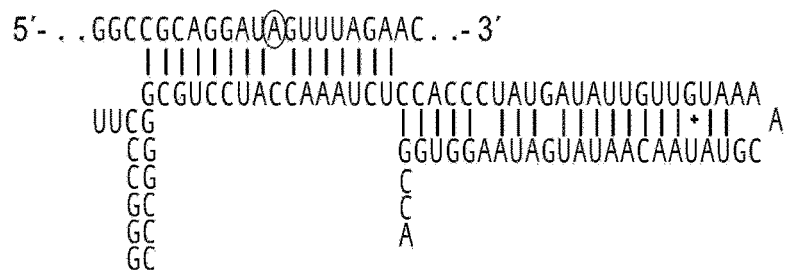
FIG. 60A

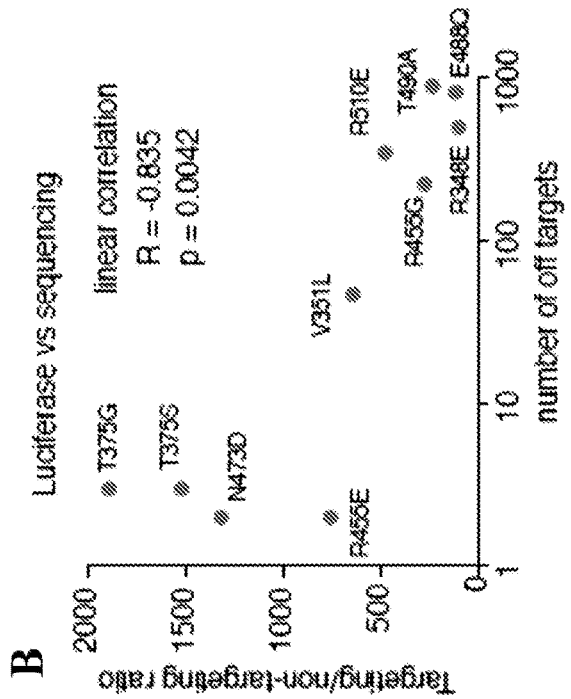
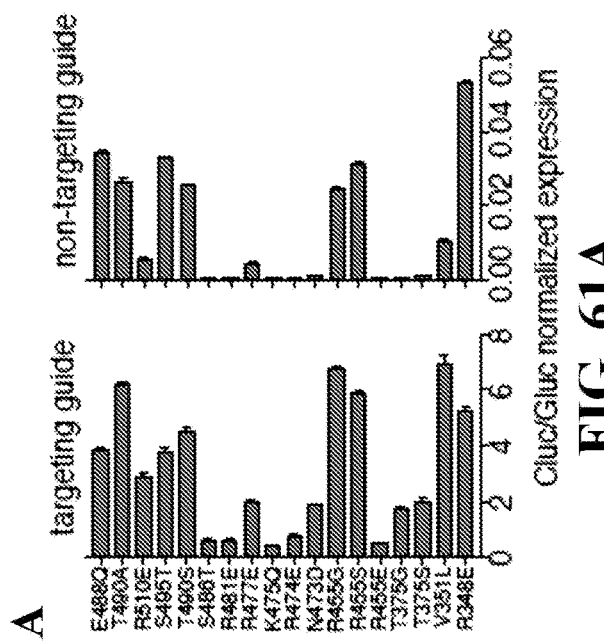
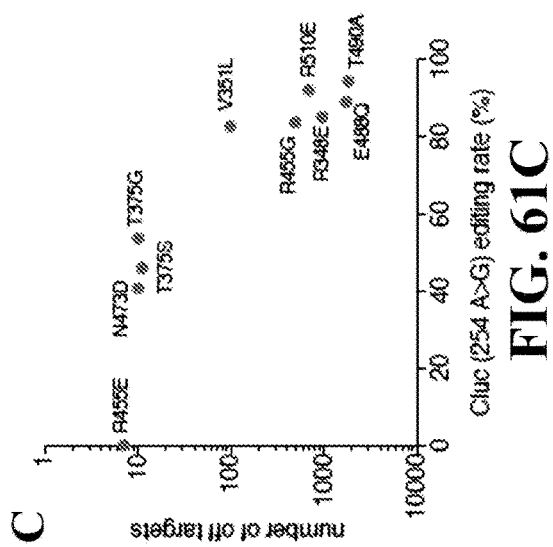
FIG. 61A
FIG. 61B
FIG. 61C

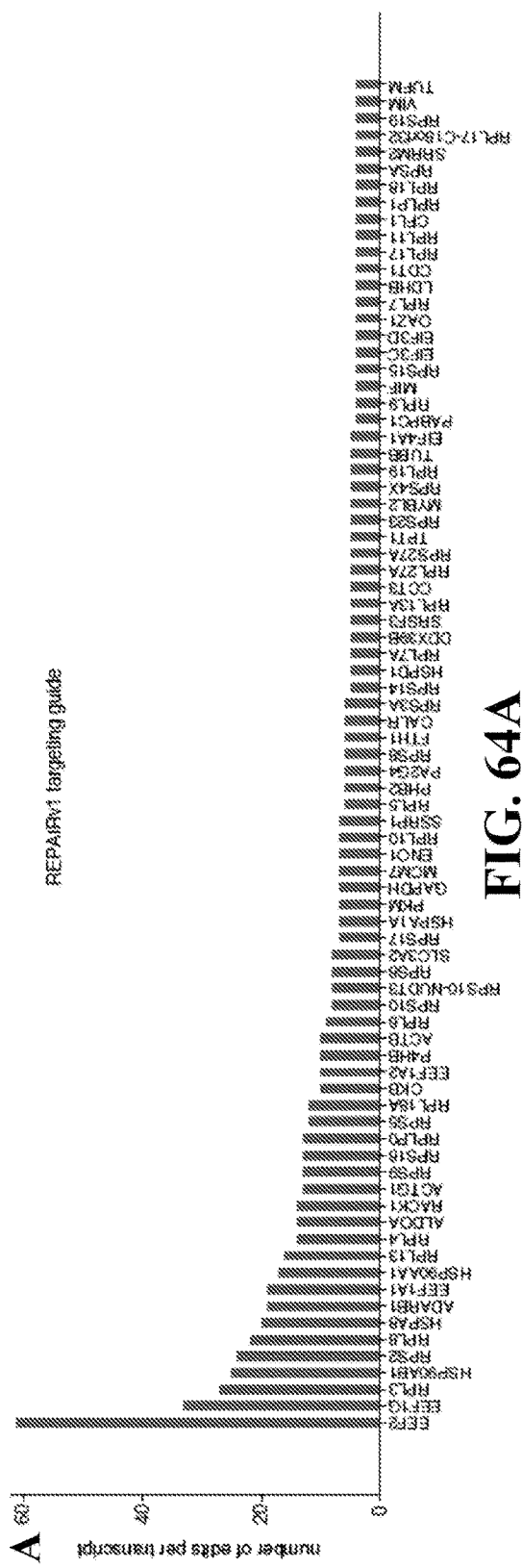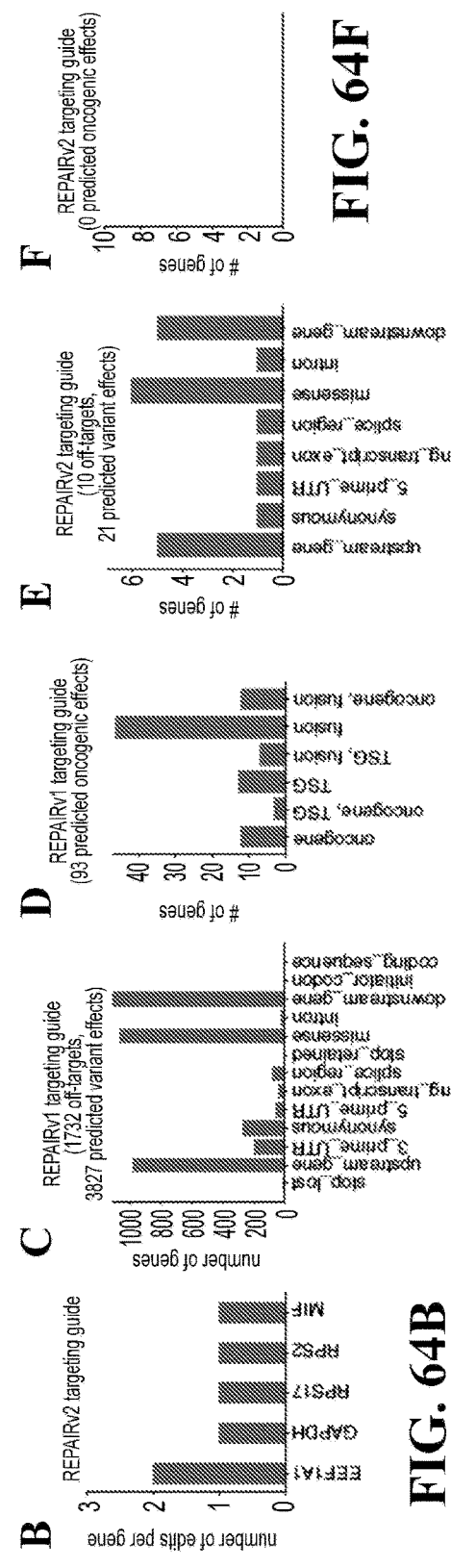

A

| Initial Codon | Edited Codon |
|---|---|
| Tyr | → Cys |
| stop | → Trp |
| His | → Arg |
| Gln | → Arg |
| Asn | → Ser / Asp |
| Lys | → Arg / Glu |
| Ser | → Gly |
| Arg | → Gly |
| Thr | → Ala |
| Ile | → Val |
| Met | → Val |

SYSTEMS METHODS, AND COMPOSITIONS FOR TARGETED NUCLEIC ACID EDITING

CROSS-REFERENCE TO RELATED APPLICATIONS

This application is a U.S. national phase entry of International Application No. PCT/US2018/054469 filed Oct. 4, 2018, which claims the benefit of U.S. Provisional Application No. 62/568,313, filed Oct. 4, 2017. The entire contents of the above-identified application are hereby fully incorporated herein by reference.

PARTIES TO A JOINT RESEARCH AGREEMENT

The claimed invention was made by, on behalf of, and/or in connection with one or more of the following parties to a joint research agreement: the Broad Institute, Inc., Massachusetts Institute of Technology, and President and Fellows of Harvard College. The joint research agreement was in effect on and before the date the claimed invention was made, and the claimed invention was made as a result of activities undertaken within the scope of the joint research agreement.

REFERENCE TO AN ELECTRONIC SEQUENCE LISTING

The contents of the electronic sequence listing ("BROD-2345WP_ST25_FOR_FILING.txt"; Size is 1,427,232 bytes and it was created on Sep. 25, 2018) is herein incorporated by reference in its entirety.

STATEMENT AS TO FEDERALLY SPONSORED RESEARCH

This invention was made with government support under grant numbers MH100706 and MH110049 granted by the National Institutes of Health. The government has certain rights in the invention.

FIELD OF THE INVENTION

The present invention generally relates to systems, methods, and compositions for targeting and editing nucleic acids, in particular for programmable deamination of adenine at a target locus of interest.

BACKGROUND

Recent advances in genome sequencing techniques and analysis methods have significantly accelerated the ability to catalog and map genetic factors associated with a diverse range of biological functions and diseases. Precise genome targeting technologies are needed to enable systematic reverse engineering of causal genetic variations by allowing selective perturbation of individual genetic elements, as well as to advance synthetic biology, biotechnological, and medical applications. Although genome-editing techniques such as designer zinc fingers, transcription activator-like effectors (TALEs), or homing meganucleases are available for producing targeted genome perturbations, there remains a need for new genome engineering technologies that employ novel strategies and molecular mechanisms and are affordable, easy to set up, scalable, and amenable to targeting multiple positions within the eukaryotic genome. This would provide a major resource for new applications in genome engineering and biotechnology.

Programmable deamination of cytosine has been reported and may be used for correction of A→G and T→C point mutations. For example, Komor et al., Nature (2016) 533: 420-424 reports targeted deamination of cytosine by APOBEC1 cytidine deaminase in a non-targeted DNA stranded displaced by the binding of a Cas9-guide RNA complex to a targeted DNA strand, which results in conversion of cytosine to uracil. See also Kim et al., Nature Biotechnology (2017) 35:371-376; Shimatani et al., Nature Biotechnology (2017) doi:10.1038/nbt.3833; Zong et al., Nature Biotechnology (2017) doi:10.1038/nbt.3811; Yang Nature Communication (2016) doi:10.1038/ncomms13330.

SUMMARY OF THE INVENTION

The present application relates to modifying a target RNA sequence of interest. Using RNA-targeting rather than DNA targeting offers several advantages relevant for therapeutic development. First, there are substantial safety benefits to targeting RNA: there will be fewer off-target events because the available sequence space in the transcriptome is significantly smaller than the genome, and if an off-target event does occur, it will be transient and less likely to induce negative side effects. Second, RNA-targeting therapeutics will be more efficient because they are cell-type independent and not have to enter the nucleus, making them easier to deliver.

In one aspect, the present disclosure includes an engineered composition for site directed base editing comprising: a targeting domain; and an adenosine deaminase or catalytic domain thereof, wherein the adenosine deaminase is modified to convert activity to a cytidine deaminase.

In some embodiments, the adenosine deaminase is modified by one or more mutations at one or more positions selected from E396, C451, V351, R455, T375, K376, S486, Q488, R510, K594, R348, G593, S397, H443, L444, Y445, F442, E438, T448, A353, V355, T339, P539, V525 and I520. In some embodiments, the adenosine deaminase is mutated at one or more positions selected from E488, V351, S486, T375, S370, P462, and N597. In some embodiments, the adenosine deaminase comprises one or more mutations selected from E488Q, V351G, S486A, T375S, S370C, P462A, and N597I. In some embodiments, the adenosine deaminase protein or catalytic domain thereof is a human, cephalopod, or *Drosophila* adenosine deaminase protein or catalytic domain thereof. In some embodiments, said adenosine deaminase protein or catalytic domain thereof has been modified to comprise a mutation at glutamic acid488 of the hADAR2-D amino acid sequence, or a corresponding position in a homologous ADAR protein. In some embodiments, said glutamic acid residue at position 488 or a corresponding position in a homologous ADAR protein is replaced by a glutamine residue (E488Q). In some embodiments, said adenosine deaminase protein or catalytic domain thereof is a mutated hADAR2d comprising mutation E488Q or a mutated hADAR1d comprising mutation E1008Q. In some embodiments, the targeting domain is a catalytically inactive Cas13 protein, or a nucleotide sequence encoding said catalytically inactive Cas13 protein. In some embodiments, the catalytically inactive Cas13 protein is catalytically inactive Cas13a, catalytically inactive Cas13b, or catalytically inactive Cas13c. In some embodiments, said catalytically inactive Cas13 protein is obtained from a Cas13 nuclease derived from a bacterial species selected from the group consisting of the bacterial species listed in any of Tables 1, 2, 3, or 4. In some embodiments, the composition further comprising a guide molecule which comprises a guide sequence linked to a direct repeat sequence, or a nucleotide sequence encoding said guide molecule. In some embodiments, said adenosine deaminase protein or catalytic domain thereof is covalently or non-covalently linked to the targeting domain.

In another aspect, the invention relates to a method of modifying an Adenine in a target RNA sequence of interest. In particular embodiments, the method comprises delivering to said target RNA: (a) a catalytically inactive (dead) Cas13 protein; (b) a guide molecule which comprises a guide sequence linked to a direct repeat sequence; and (c) an adenosine deaminase protein or catalytic domain thereof, wherein said adenosine deaminase protein or catalytic domain thereof is covalently or non-covalently linked to said dead Cas13 protein or said guide molecule or is adapted to link thereto after delivery; wherein guide molecule forms a complex with said dead Cas13 protein and directs said complex to bind said target RNA sequence of interest, wherein said guide sequence is capable of hybridizing with a target sequence comprising said Adenine to form an RNA duplex, wherein said guide sequence comprises a non-pairing Cytosine at a position corresponding to said Adenine resulting in an A-C mismatch in the RNA duplex formed; wherein said adenosine deaminase protein or catalytic domain thereof deaminates said Adenine in said RNA duplex.

In certain example embodiment the Cas13 protein is Cas13a, Cas13b or Cas13c.

The adenosine deaminase protein or catalytic domain thereof is fused to N- or C-terminus of said dead Cas13 protein. In certain example embodiments, the adenosine deaminase protein or catalytic domain thereof is fused to said dead Cas13 protein by a linker. The linker may be $(GGGGS)_{3-11}$ (SEQ ID Nos. 1-9) $GSG_5$ (SEQ ID No. 10) or LEPGEKPYKCPECGKSFSQSGALTRHQRTHTR (SEQ ID No. 11).

In certain example embodiments, the adenosine deaminase protein or catalytic domain thereof is linked to an adaptor protein and said guide molecule or said dead Cas13 protein comprises an aptamer sequence capable of binding to said adaptor protein. The adaptor sequence may be selected from MS2, PP7, Qβ, F2, GA, fr, JP501, M12, R17, BZ13, JP34, JP500, KU1, M11, MX1, TW18, VK, SP, FI, ID2, NL95, TW19, AP205, φCb5, φCb8r, φCb12r, φCb23r, 7s and PRR1.

In certain example embodiments, the adenosine deaminase protein or catalytic domain thereof is inserted into an internal loop of said dead Cas13 protein. In certain example embodiments, the Cas13a protein comprises one or more mutations in the two HEPN domains, particularly at position R474 and R1046 of Cas 13a protein originating from *Leptotrichia wadei* or amino acid positions corresponding thereto of a Cas13a ortholog.

In certain example embodiments, the Cas 13 protein is a Cas13b proteins, and the Cas13b comprises a mutation in one or more of positions R116, H121, R1177, H1182 of Cas13b protein originating from *Bergeyella zoohelcum* ATCC 43767 or amino acid positions corresponding thereto of a Cas13b ortholog. In certain other example embodiments, the mutation is one or more of R116A, H121A, R1177A, H1182A of Cas13b protein originating from *Bergeyella zoohelcum* ATCC 43767 or amino acid positions corresponding thereto of a Cas13b ortholog.

In certain example embodiments, the guide sequence has a length of about 29-53 nt capable of forming said RNA duplex with said target sequence. In certain other example embodiments, the guide sequence has a length of about 40-50 nt capable of forming said RNA duplex with said target sequence. In certain example embodiments, the distance between said non-pairing C and the 5' end of said guide sequence is 20-30 nucleotides.

In certain example embodiments, the adenosine deaminase protein or catalytic domain thereof is a human, cephalopod, or *Drosophila* adenosine deaminase protein or catalytic domain thereof. In certain example embodiments, the adenosine deaminase protein or catalytic domain thereof has been modified to comprise a mutation at glutamic acid$^{488}$ of the hADAR2-D amino acid sequence, or a corresponding position in a homologous ADAR protein. In certain example embodiments, the glutamic acid residue may be at position 488 or a corresponding position in a homologous ADAR protein is replaced by a glutamine residue (E488Q).

In certain other example embodiments, the adenosine deaminase protein or catalytic domain thereof is a mutated hADAR2d comprising mutation E488Q or a mutated hADAR1d comprising mutation E1008Q.

In certain example embodiments, the guide sequence comprises more than one mismatch corresponding to different adenosine sites in the target RNA sequence or wherein two guide molecules are used, each comprising a mismatch corresponding to a different adenosine sites in the target RNA sequence.

In certain example embodiments, the Cas13 protein and optionally said adenosine deaminase protein or catalytic domain thereof comprise one or more heterologous nuclear localization signal(s) (NLS(s)).

In certain example embodiments, the method further comprises, determining the target sequence of interest and selecting an adenosine deaminase protein or catalytic domain thereof which most efficiently deaminates said Adenine present in then target sequence.

The target RNA sequence of interest may be within a cell. The cell may be a eukaryotic cell, a non-human animal cell, a human cell, a plant cell. The target locus of interest may be within an animal or plant.

The target RNA sequence of interest may comprise in an RNA polynucleotide in vitro.

The components of the systems described herein may be delivered to said cell as a ribonucleoprotein complex or as one or more polynucleotide molecules. The one or more polynucleotide molecules may comprise one or more mRNA molecules encoding the components. The one or more polynucleotide molecules may be comprised within one or more vectors. The one or more polynucleotide molecules may further comprise one or more regulatory elements operably configured to express said Cas13 protein, said guide molecule, and said adenosine deaminase protein or catalytic domain thereof, optionally wherein said one or more regulatory elements comprise inducible promoters. The one or more polynucleotide molecules or said ribonucleoprotein complex may be delivered via particles, vesicles, or one or more viral vectors. The particles may comprise a lipid, a sugar, a metal or a protein. The particles may comprise lipid nanoparticles. The vesicles may comprise exosomes or liposomes. The one or more viral vectors may comprise one or more of adenovirus, one or more lentivirus or one or more adeno-associated virus.

The methods disclosed herein may be used to modify a cell, a cell line or an organism by manipulation of one or more target RNA sequences.

In certain example embodiments, the deamination of said Adenine in said target RNA of interest remedies a disease caused by transcripts containing a pathogenic G→A or C→T point mutation.

The methods maybe be used to treat a disuse. In certain example embodiments, the disease is selected from Meier-Gorlin syndrome, Seckel syndrome 4, Joubert syndrome 5, Leber congenital amaurosis 10; Charcot-Marie-Tooth disease, type 2; Charcot-Marie-Tooth disease, type 2; Usher syndrome, type 2C; Spinocerebellar ataxia 28; Spinocerebellar ataxia 28; Spinocerebellar ataxia 28; Long QT syndrome 2; Sjögren-Larsson syndrome; Hereditary fructosuria; Hereditary fructosuria; Neuroblastoma; Neuroblastoma; Kallmann syndrome 1; Kallmann syndrome 1; Kallmann syndrome 1; Metachromatic leukodystrophy, Rett syndrome, Amyotrophic lateral sclerosis type 10, Li-Fraumeni syndrome, or a disease listed in Table 5. The disease may be a premature termination disease.

The methods disclosed herein, may be used to make a modification that affects the fertility of an organism. The modification may affects splicing of said target RNA sequence. The modification may introduce a mutation in a transcript introducing an amino acid change and causing expression of a new antigen in a cancer cell.

In certain example embodiments, the target RNA may be a microRNA or comprised within a microRNA. In certain example embodiments, the deamination of said Adenine in said target RNA of interest causes a gain of function or a loss of function of a gene. In certain example embodiments, the gene is a gene expressed by a cancer cell.

In certain example embodiments, said cytosine is not 5' flanked by guanosine. In certain example embodiments, said adenosine deaminase is ADAR, optionally huADAR, optionally (hu)ADAR1 or (hu)ADAR2. In certain example embodiments, said Cas13, preferably Cas13b, is truncated, preferably C-terminally truncated, preferably wherein said Cas 13 is a truncated functional variant of the corresponding wild type Cas13. In certain example embodiments, said adenosine deaminase is an RNA specific adenosine deaminase. In certain example embodiments, said adenosine deaminase protein or catalytic domain thereof has been modified to comprise one or more mutation of the ADAR, preferably a mutation as described herein, for instance a mutation as provided in any of FIGS. 43A-43D, 44, 45, 46A-46B, 47A-47B, or a corresponding mutation in an ADAR homologue or orthologue.

In another aspect, the invention comprises a modified cell or progeny thereof that is obtained using the methods disclosed herein, wherein said cell comprises a hypoxanthine or a guanine in replace of said Adenine in said target RNA of interest compared to a corresponding cell not subjected to the method. The modified cell or progeny thereof may be a eukaryotic cell an animal cell, a human cell, a therapeutic T cell, an antibody-producing B cell, a plant cell.

In another aspect, the invention comprises a non-human animal comprising said modified cell or progeny thereof. The modified may be a plant cell.

In another aspect, the invention comprises a method for cell therapy, comprising administering to a patient in need thereof the modified cells disclosed herein, wherein the presence of said modified cell remedies a disease in the patient.

In another aspect, the invention is directed to an engineered, non-naturally occurring system suitable for modifying an Adenine in a target locus of interest, comprising A) a guide molecule which comprises a guide sequence linked to a direct repeat sequence, or a nucleotide sequence encoding said guide molecule; B) a catalytically inactive Cas13 protein, or a nucleotide sequence encoding said catalytically inactive Cas13 protein; C) an adenosine deaminase protein or catalytic domain thereof, or a nucleotide sequence encoding said adenosine deaminase protein or catalytic domain thereof, wherein said adenosine deaminase protein or catalytic domain thereof is covalently or non-covalently linked to said Cas13 protein or said guide molecule or is adapted to link thereto after delivery; wherein said guide sequence is capable of hybridizing with a target RNA sequence comprising an Adenine to form an RNA duplex, wherein said guide sequence comprises a non-pairing Cytosine at a position corresponding to said Adenine resulting in an A-C mismatch in the RNA duplex formed.

In another aspect, the invention is directed to an engineered, non-naturally occurring vector system suitable for modifying an Adenine in a target locus of interest, comprising the nucleotide sequences of a), b) and c)

In another aspect, the invention is directed to an engineered, non-naturally occurring vector system, comprising one or more vectors comprising: a first regulatory element operably linked to a nucleotide sequence encoding said guide molecule which comprises said guide sequence, a second regulatory element operably linked to a nucleotide sequence encoding said catalytically inactive Cas13 protein; and a nucleotide sequence encoding an adenosine deaminase protein or catalytic domain thereof which is under control of said first or second regulatory element or operably linked to a third regulatory element; wherein, if said nucleotide sequence encoding an adenosine deaminase protein or catalytic domain thereof is operably linked to a third regulatory element, said adenosine deaminase protein or catalytic domain thereof is adapted to link to said guide molecule or said Cas13 protein after expression; wherein components A), B) and C) are located on the same or different vectors of the system.

As the methods disclosed herein demonstrate the ability of Cas13 proteins to function in mammalian cells for binding and specificity of cleaving RNA, additional extended applications include editing splice variants, and measuring how RNA-binding proteins interact with RNA.

In another aspect, the invention is directed to in vitro or ex vivo host cell or progeny thereof or cell line or progeny thereof comprising the systems disclosed herein. The host cell or progeny thereof may be a eukaryotic cell, an animal cell, a human cell, or a plant cell.

In another aspect, the present disclosure includes a method of modifying an Adenine in a target RNA sequence of interest, comprising delivering to said target RNA: (a) a catalytically inactive (dead) Cas13 protein; (b) a guide molecule which comprises a guide sequence linked to a direct repeat sequence; and (c) an adenosine deaminase protein or catalytic domain thereof mutated to convert activity to a cytidine deaminase; wherein said adenosine deaminase protein or catalytic domain thereof is covalently or non-covalently linked to said dead Cas13 protein or said guide molecule or is adapted to link thereto after delivery; wherein said guide molecule forms a complex with said dead Cas13 protein and directs said complex to bind said target RNA sequence of interest, wherein said guide sequence is capable of hybridizing with a target sequence comprising said Adenine to form an RNA duplex, wherein said guide sequence comprises a non-pairing Cytosine at a position corresponding to said Adenine resulting in an A-C mismatch in the RNA duplex formed; wherein said adenosine deaminase protein or catalytic domain thereof deaminates said Adenine in said RNA duplex.

In some example embodiments, the adenosine deaminase is mutated at one or more positions selected from E396, C451, V351, R455, T375, K376, S486, Q488, R510, K594, R348, G593, S397, H443, L444, Y445, F442, E438, T448, A353, V355, T339, P539, V525 and I520. In some example embodiments, the adenosine deaminase is mutated at one or more positions selected from E488, V351, S486, T375, S370, P462, and N597.

In another aspect, the present disclosure includes an engineered, non-naturally occurring system suitable for modifying an Adenine in a target locus of interest, comprising (a) a guide molecule which comprises a guide sequence linked to a direct repeat sequence, or a nucleotide sequence encoding said guide molecule; (b) a catalytically inactive Cas13 protein, or a nucleotide sequence encoding said catalytically inactive Cas13 protein; (c) an adenosine deaminase protein or catalytic domain thereof, or a nucleotide sequence encoding said adenosine deaminase protein or catalytic domain thereof, wherein the adenosine deaminase is modified to convert activity to a cytidine deaminase; wherein said adenosine deaminase protein or catalytic domain thereof is covalently or non-covalently linked to said Cas13 protein or said guide molecule or is adapted to link thereto after delivery; wherein said guide sequence is capable of hybridizing with a target RNA sequence comprising an Adenine to form an RNA duplex, wherein said guide sequence comprises a non-pairing Cytosine at a position corresponding to said Adenine resulting in an A-C mismatch in the RNA duplex formed.

In some example embodiments, the adenosine deaminase is modified by one or more mutations selected from E396, C451, V351, R455, T375, K376, S486, Q488, R510, K594, R348, G593, S397, H443, L444, Y445, F442, E438, T448, A353, V355, T339, P539, V525 and I520. In some example embodiments, the adenosine deaminase is mutated at one or more positions selected from E488, V351, S486, T375, S370, P462, and N597.

These and other aspects, objects, features, and advantages of the example embodiments will become apparent to those having ordinary skill in the art upon consideration of the following detailed description of illustrated example embodiments.

BRIEF DESCRIPTION OF THE DRAWINGS

An understanding of the features and advantages of the present invention will be obtained by reference to the following detailed description that sets forth illustrative embodiments, in which the principles of the invention may be utilized, and the accompanying drawings of which:

FIG. 4 Exemplary sequences of adenine deaminase proteins. (SEQ ID Nos. 650-656)

FIGS. 13A-13C: Cas13a/b+shRNA specificity from RNA Seq.

(FIG. 20A) Schematic of representative Cas13a, Cas13b, and Cas13c loci and associated crRNAs. (FIG. 20B) Schematic of luciferase assay to measure Cas13a cleavage activity in HEK293FT cells. (FIG. 20C) RNA knockdown efficiency using two different guides targeting Cluc with 19 Cas13a, 15 Cas13b, and 5 Cas13c orthologs. Luciferase expression is normalized to the expression in non-targeting guide control conditions. (FIG. 20D) The top 7 orthologs performing in part C are assayed for activity with three different NLS and NES tags with two different guide RNAs targeting Cluc. (FIG. 20E) Cas13b12 and Cas13a2 (LwCas13a) are compared for knockdown activity against Gluc and Cluc. Guides are tiled along the transcripts and guides between Cas13b12 and Cas13a2 are position matched. (FIG. 20F) Guide knockdown for Cas13a2, Cas13b6, Cas13b11, and Cas13b12 against the endogenous KRAS transcript and are compared against corresponding shRNAs.

FIGS. 21A-21G: Cas13 enzymes mediate specific RNA knockdown in mammalian cells. (FIG. 21A) Schematic of semi-degenerate target sequences for Cas13a/b mismatch specificity testing. (SEQ ID Nos. 673-694) (FIG. 21B) Heatmap of single mismatch knockdown data for Cas13 a/b. Knockdown is normalized to non-targeting (NT) guides for each enzyme. (FIG. 21C) Double mismatch knockdown data for Cas13a. The position of each mismatch is indicated on the X and Y axes. Knockdown data is the sum of all double mismatches for a given set of positions. Data is normalized to NT guides for each enzyme. (FIG. 21D) Double mismatch knockdown data for Cas13b. See C for description. (FIG. 21E) RNA-seq data comparing transcriptome-wide specificity for Cas13 a/b and shRNA for position-matched guides. The Y axis represents read counts for the targeting condition and the X axis represents counts for the non-targeting condition. (FIG. 21F) RNA expression as calculated from RNA-seq data for Cas13 a/b and shRNA. (FIG. 21G) Significant off-targets for Cas13 a/b and shRNA from RNA-seq data. Significant off-targets were calculated using FDR<0.05.

(FIG. 22A) Schematic of RNA editing with Cas13b-ADAR fusion proteins to remove stop codons on the *Cypridina* luciferase transcript. (FIG. 22B) RNA editing comparison between Cas13b fused with wild-type ADAR2 and Cas13b fused with the hyperactive ADAR2 E488Q mutant for multiple guide positions. Luciferase expression is normalized to *Gaussia* luciferase control values. (FIG. 22C) RNA editing comparisons between 30, 50, 70, and 84 nt guides designed to target various positions surrounding the editing site. (FIG. 22D) Schematic showing the position and length of guides used for sequencing quantification relative to the stop codon on the *Cypridina* luciferase transcript. (SEQ ID No. 695) (FIG. 22E) On- and off-target editing efficiencies for each guide design at the corresponding adenine bases on the *Cypridina* luciferase transcript as quantified by sequencing. (FIG. 22F) Luciferase readout of guides with varied bases opposite to the targeted adenine.

(FIG. 25A) Cas13b-huADAR2 promotes repair of mutated luciferase transcripts. (FIG. 25B) Cas13b-huADAR1 promotes repair of mutated luciferase transcripts. (FIG. 25C) Comparison of human ADAR1 and human ADAR2.

FIGS. 27A-27B: Transcripts targeted by Cas13b-huA-DAR2-E488Q contain the expected A-G edit. (FIG. 27A) heatmap. (FIG. 27B) Positions in template. Only A sites are shown with the editing rate to G as in heatmap.

(FIG. 28A) KRAS: heatmap. (top) Positions in template (bottom). Only A sites are shown with the editing rate to G as in heatmap. (FIG. 28B) PPIB: heatmap. (top) Positions in template (bottom). Only A sites are shown with the editing rate to G as in heatmap.

FIGS. 33A-33D: Screening degenerate PFS locations for effect on editing efficiency. All PFS (4-N) identities have higher editing than non-targeting. Shown are SEQ ID No. 697, 698, 699, and 703 in panel A.

(FIG. 36A) targeting guide; 482 significant sites. (FIG. 36B) non-targeting guide; 949 significant sites. Note that chromosome 0 is Gluc and chromosome 1 is Cluc; human chromosomes are then in order after that.

FIGS. 37A-37B: Cas13b-ADAR transcriptome specificity. (FIG. 37A) targeting guide. (FIG. 37B) non-targeting guide.

(FIG. 39A) targeting guide—2020 significant sites; (FIG. 39B) non-targeting guide—1805 significant sites. (FIG. 39C-FIG. 39D) Stafforst; on-target editing is 36%; (FIG. 39C) targeting guide—176 significant sites; (FIG. 39D) non-targeting guide—186 significant sites.

(FIG. 41A-FIG. 41B) 150 ng Cas13-ADAR; on-target editing is 83%; (FIG. 41A) targeting guide—1231 significant sites; (FIG. 41B) non-targeting guide—520 significant sites. (FIG. 41C-FIG. 41D) 10 ng Cas13-ADAR; on-target editing is 80%; (FIG. 41C) targeting guide—347 significant sites; (FIG. 41D) non-targeting guide—223 significant sites.

(FIG. 42A) targeting guide; 11 significant sites. (FIG. 42B) non-targeting guide; 6 significant sites. Note that chromosome 0 is Gluc and chromosome 1 is Cluc; human chromosomes are then in order after that.

(FIG. 43A) Targeting guide. (FIG. 43B) Non-targeting guide. (FIG. 43C) Targeting to non-targeting ratio. (FIG. 43D) Targeting and non-targeting guide.

(FIG. 46A) on target. (FIG. 46B) Off-target.

(FIG. 47A) Targeting guide selected for NGS. (FIG. 47B) Non-targeting guide selected for NGS. Luciferase data matches the NGS data in FIGS. 46A-46B. The orthologs that have fewer activity with non-targeting guide have fewer off-targets across the transcriptome and their on-target editing efficiency can be predicted by the targeting guide luciferase condition.

(FIG. 49B) Evaluation of 19 Cas13a, 15 Cas13b, and 7 Cas13c orthologs for luciferase knockdown using two different guides. Orthologs with efficient knockdown using both guides are labeled with their host organism name. (FIG. 49C) PspCas13b and LwaCas13a knockdown activity are compared by tiling guides against Gluc and measuring luciferase expression. (FIG. 49D) PspCas13b and LwaCas13a knockdown activity are compared by tiling guides against Cluc and measuring luciferase expression. (FIG. 49E) Expression levels in log 2(transcripts per million (TPM)) values of all genes detected in RNA-seq libraries of non-targeting control (x-axis) compared to Gluc-targeting condition (y-axis) for LwaCas13a (red) and shRNA (black). Shown is the mean of three biological replicates. The Gluc transcript data point is labeled. (FIG. 49F) Expression levels in log 2(transcripts per million (TPM)) values of all genes detected in RNA-seq libraries of non-targeting control (x-axis) compared to Gluc-targeting condition (y-axis) for PspCas13b (blue) and shRNA (black). Shown is the mean of three biological replicates. The Gluc transcript data point is labeled. (FIG. 49G) Number of significant off-targets from Gluc knockdown for LwaCas13a, PspCas13b, and shRNA from the transcriptome wide analysis in E and F.

(FIG. 50B) Schematic of *Cypridina* luciferase W85X target and targeting guide design. (SEQ ID Nos. 700 and 701) (FIG. 50C) Quantification of luciferase activity restoration for Cas13b-dADAR1 (left) and Cas13b-ADAR2-cd (right) with tiling guides of length 30, 50, 70, or 84 nt. (FIG. 50D) Schematic of target site for targeting *Cypridina* luciferase W85X. (SEQ ID No. 702) (FIG. 50E) Sequencing quantification of A→I editing for 50 nt guides targeting *Cypridina* luciferase W85X.

FIGS. 51A-51D: (FIG. 51A) Measuring sequence flexibility for RNA editing by REPAIRv1 Schematic of screen for determining Protospacer Flanking Site (PFS) preferences of RNA editing by REPAIRv1. Shown is SEQ ID No. 737. (FIG. 51B) Distributions of RNA editing efficiencies for all 4-N PFS combinations at two different editing sites. (FIG. 51C) Quantification of the percent editing of REPAIRv1 at Cluc W85 across all possible 3 base motifs. (FIG. 51D) Heatmap of 5' and 3' base preferences of RNA editing at Cluc W85 for all possible 3 base motifs.

(FIG. 52C) Schematic of target and guide design for targeting FANCC 1517G>A. (SEQ ID Nos. 709-712) (FIG. 52D) The 1517G>A mutation in FANCC is corrected to varying percentages using REPAIRv1 with three different guide designs. (FIG. 52E) Quantification of the percent editing of 34 different disease-relevant G>A mutations using REPAIRv1. (FIG. 52F) Analysis of all the possible G>A mutations that could be corrected as annotated by the ClinVar database. (FIG. 52G) The distribution of editing motifs for all G>A mutations in ClinVar is shown versus the editing efficiency by REPAIRv1 per motif as quantified on the Glue transcript.

FIGS. 53A-53D: Characterizing specificity of REPAIRv1 (FIG. 53A) Schematic of KRAS target site and guide design. (SEQ ID Nos. 713-720) (FIG. 53B) Quantification of percent editing for tiled KRAS-targeting guides. Editing percentages are shown at the on-target and neighboring adenosine sites. For each guide, the region of duplex RNA is indicated by a red rectangle. (FIG. 53C) Transcriptome-wide sites of significant RNA editing by REPAIRv1 with Cluc targeting guide. The on-target site Cluc site (254 A>G) is highlighted in orange. (FIG. 53D) Transcriptome-wide sites of significant RNA editing by REPAIRv1 with non-targeting guide.

FIGS. 54A-54F: Rational mutagenesis of ADAR2 to improve the specificity of REPAIRv1 (FIG. 54A) Quantification of luciferase signal restoration by various dCas13-ADAR2 mutants as well as their specificity score plotted along a schematic for the contacts between key ADAR2 deaminase residues and the dsRNA target. The specificity score is defined as the ratio of the luciferase signal between targeting guide and non-targeting guide conditions. Shown are SEQ ID No. 738 and 739. (FIG. 54B) Quantification of luciferase signal restoration by various dCas13-ADAR2 mutants versus their specificity score. (FIG. 54C) Measurement of the on-target editing fraction as well as the number of significant off-targets for each dCas13-ADAR2 mutant by transcriptome wide sequencing of mRNAs. (FIG. 54D) Transcriptome-wide sites of significant RNA editing by REPAIRv1 and REPAIRv2 with a guide targeting a pretermination site in Cluc. The on-target Cluc site (254 A>G) is highlighted in orange. (FIG. 54E) RNA sequencing reads surrounding the on-target Cluc editing site (SEQ ID No. 721, 740-745, and 763-792) (254 A>G) highlighting the differences in off-target editing between REPAIRv1 and REPAIRv2. All A>G edits are highlighted in red while sequencing errors are highlighted in blue. (FIG. 54F) RNA editing by REPAIRv1 and REPAIRv2 with guides targeting an out-of-frame UAG site in the endogenous KRAS and PPIB transcripts. The on-target editing fraction is shown as a sideways bar chart on the right for each condition row. The duplex region formed by the guide RNA is shown by a red outline box.

FIGS. 55A-55C: Bacterial screening of Cas13b orthologs for in vivo efficiency and PFS determination. (FIG. 55A) Schematic of bacterial assay for determining the PFS of Cas13b orthologs. Cas13b orthologs with beta-lactamase targeting spacers (SEQ ID No. 722) are co-transformed with beta-lactamase expression plasmids and subjected to double selection. (FIG. 55B) Quantitation of interference activity of Cas13b orthologs targeting beta-lactamase as measured by colony forming units (cfu). (FIG. 55C) PFS logos for Cas13b orthologs as determined by depleted sequences from the bacterial assay.

FIGS. 56A-56E: Optimization of Cas13b knockdown and further characterization of mismatch specificity. (FIG. 56A) Gluc knockdown with two different guides is measured using the top 2 Cas13a and top 4 Cas13b orthologs fused to a variety of nuclear localization and nuclear export tags. (FIG. 56B) Knockdown of KRAS is measured for LwaCas13a, RanCas13b, PguCas13b, and PspCas13b with four different guides and compared to four position-matched shRNA controls. (FIG. 56C) Schematic of the single and double mismatch plasmid libraries used for evaluating the specificity of LwaCas13a and PspCas13b knockdown. Every possible single and double mismatch is present in the target sequence as well as in 3 positions directly flanking the 5' and 3' ends of the target site. (SEQ ID Nos. 723-734) (FIG. 56D) The depletion level of transcripts with the indicated single mismatches are plotted as a heatmap for both the LwaCas13a and PspCas13b conditions. (SEQ ID Nos. 723 and 736) (FIG. 56E) The depletion level of transcripts with the indicated double mismatches are plotted as a heatmap for both the LwaCas13a and PspCas13b conditions (SEQ ID Nos. 723 and 736).

(FIG. 57B) Quantification of luciferase activity restoration by dCas13b fused to either the wildtype ADAR2 catalytic domain or the hyperactive E488Q mutant ADAR2 catalytic domain, tested with tiling Cluc targeting guides. (FIG. 57C)

Guide design and sequencing quantification of A→I editing for 30 nt guides targeting Cypridina luciferase W85X (SEQ ID Nos. 793-801). (FIG. 57D) Guide design and sequencing quantification of A→I editing for 50 nt guides targeting PPIB (SEQ ID Nos. 746-753). (FIG. 57E) Influence of linker choice on luciferase activity restoration by REPAIRv1. (FIG. 57F) Influence of base identify opposite the targeted adenosine on luciferase activity restoration by REPAIRv1 (SEQ ID Nos. 754 and 755).

FIGS. 60A-60F: Comparison of other programmable ADAR systems with the dCas13-ADAR2 editor. (FIG. 60A) Schematic of two programmable ADAR schemes: BoxB-based targeting and full length ADAR2 targeting. In the BoxB scheme (top), the ADAR2 deaminase domain (ADAR2$_{DD}$(E488Q)) is fused to a small bacterial virus protein called lambda N (λN), which binds specifically a small RNA sequence called BoxB-λ. A guide RNA containing two BoxB-λhairpins can then guide the ADAR2$_{DD}$(E488Q), -λN for site specific editing. In the full length ADAR2 scheme (bottom), the dsRNA binding domains of ADAR2 bind a hairpin in the guide RNA, allowing for programmable ADAR2 editing (SEQ ID Nos. 756-760). (FIG. 60B) Transcriptome-wide sites of significant RNA editing by BoxB-ADAR2$_{DD}$(E488Q) with a guide targeting Cluc and a non-targeting guide. The on-target Cluc site (254 A>G) is highlighted in orange. (FIG. 60C) Transcriptome-wide sites of significant RNA editing by ADAR2 with a guide targeting Cluc and a non-targeting guide. The on-target Cluc site (254 A>G) is highlighted in orange. (FIG. 60D) Transcriptome-wide sites of significant RNA editing by REPAIRv1 with a guide targeting Cluc and a non-targeting guide. The on-target Cluc site (254 A>G) is highlighted in orange. (FIG. 60E) Quantitation of on-target editing rate percentage for BoxB-ADAR2$_{DD}$(E488Q), ADAR2, and REPAIRv1 for targeting guides against Cluc. (FIG. 60F) Overlap of off-target sites between different targeting and non-targeting conditions for programmable ADAR systems.

FIGS. 61A-61C: Efficiency and specificity of dCas13b-ADAR2 mutants (FIG. 61A) Quantitation of luciferase activity restoration by dCas13b-ADAR2$_{DD}$(E488Q) mutants for Cluc-targeting and non-targeting guides. (FIG. 61B) Relationship between the ratio of targeting and non-targeting guides and the number of RNA-editing off-targets as quantified by transcriptome-wide sequencing (FIG. 61C) Quantification of number of transcriptome-wide off-target RNA editing sites versus on-target Cluc editing efficiency for dCas13b-ADAR2$_{DD}$(E488Q) mutants.

(FIG. 62B) Transcriptome-wide sites of significant RNA editing by dCas13b-ADAR2$_{DD}$(E488Q) mutants with a non-targeting guide.

(FIG. 63A) For each dCas13b-ADAR2$_{DD}$(E488Q) mutant, the motif present across all A>G off-target edits in the transcriptome is shown. (FIG. 63B) The distribution of off-target A>G edits per motif identity is shown for REPAIRv1 with targeting and non-targeting guide. (FIG. 63C) The distribution of off-target A>G edits per motif identity is shown for REPAIRv2 with targeting and non-targeting guide.

FIGS. 64A-64F: Further characterization of REPAIRv1 and REPAIRv2 off-targets. (FIG. 64A) Histogram of the number of off-targets per transcript for REPAIRv1. (FIG. 64B) Histogram of the number of off-targets per transcript for REPAIRv2. (FIG. 64C) Variant effect prediction of REPAIRv1 off targets. (FIG. 64D) Distribution of potential oncogenic effects of REPAIRv1 off targets. (FIG. 64E) Variant effect prediction of REPAIRv2 off targets. (FIG. 64F) Distribution of potential oncogenic effects of REPAIRv2 off targets.

(FIG. 65A) Quantification of percent editing of KRAS with KRAS-targeting guide 1 at the targeted adenosine and neighboring sites for REPAIRv1 and REPAIRv2. (FIG. 65B) Quantification of percent editing of KRAS with KRAS-targeting guide 3 at the targeted adenosine and neighboring sites for REPAIRv1 and REPAIRv2. (FIG. 65C) Quantification of percent editing of PPIB with PPIB-targeting guide 2 at the targeted adenosine and neighboring sites for REPAIRv1 and REPAIRv2.

FIGS. 66A-66G: Demonstration of all potential codon changes with a A>G RNA editor. (FIG. 66A) Table of all potential codon transitions enabled by A>I editing. (FIG. 66B) A codon table demonstrating all the potential codon transitions enabled by A>I editing. (FIG. 66C shows gene editing by ADAR and dCas13b. (FIG. 66D) shows an example of correcting a Mendelian disease by ADAR. (FIG. 66E) shows an example of multiplexed creation of disease-protective alleles. (FIG. 66F) shows an example of modulating protein function. (FIG. 66G) shows an example of splicing modulation.

Figure 1:
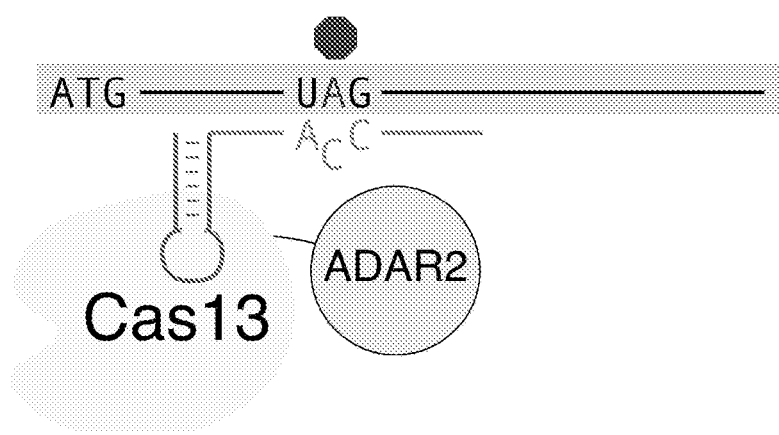
FIG. 1 illustrates an example embodiment of the invention for targeted deamination of adenine at a target RNA sequence of interest, exemplified herein with a Cas13b protein.
Figure 2:
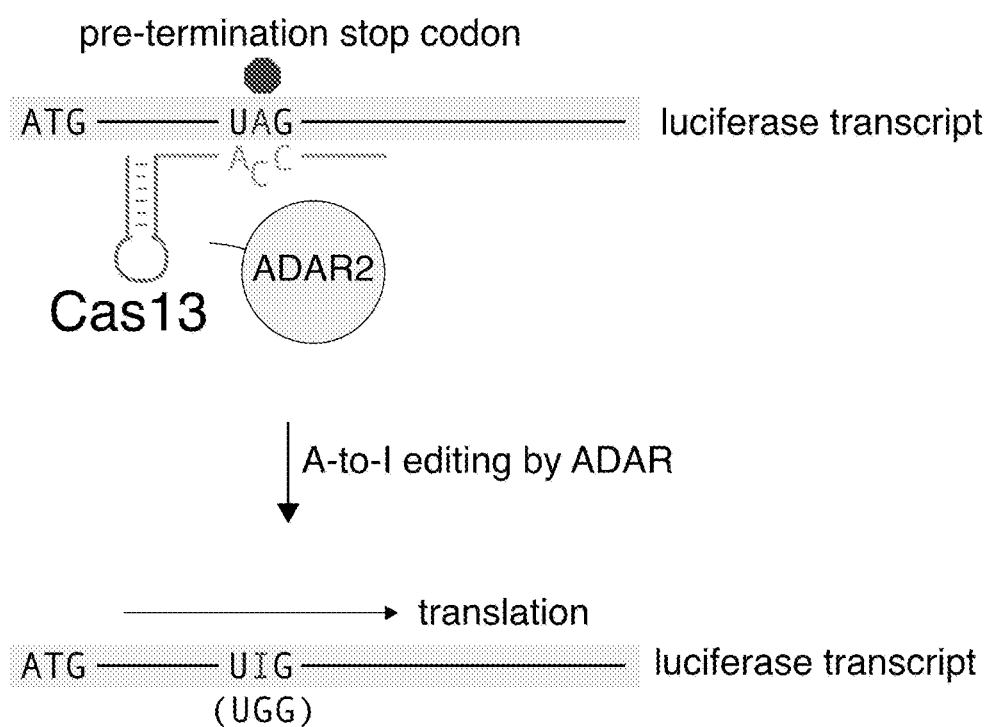
FIG. 2 illustrates the Development of RNA editing as a therapeutic strategy to treat human disease at the transcript level such as when using Cas13b. Schematic of RNA base editing by Cas13-ADAR2 fusion targeting an engineered pre-termination stop codon in the luciferase transcript.
Figure 3:
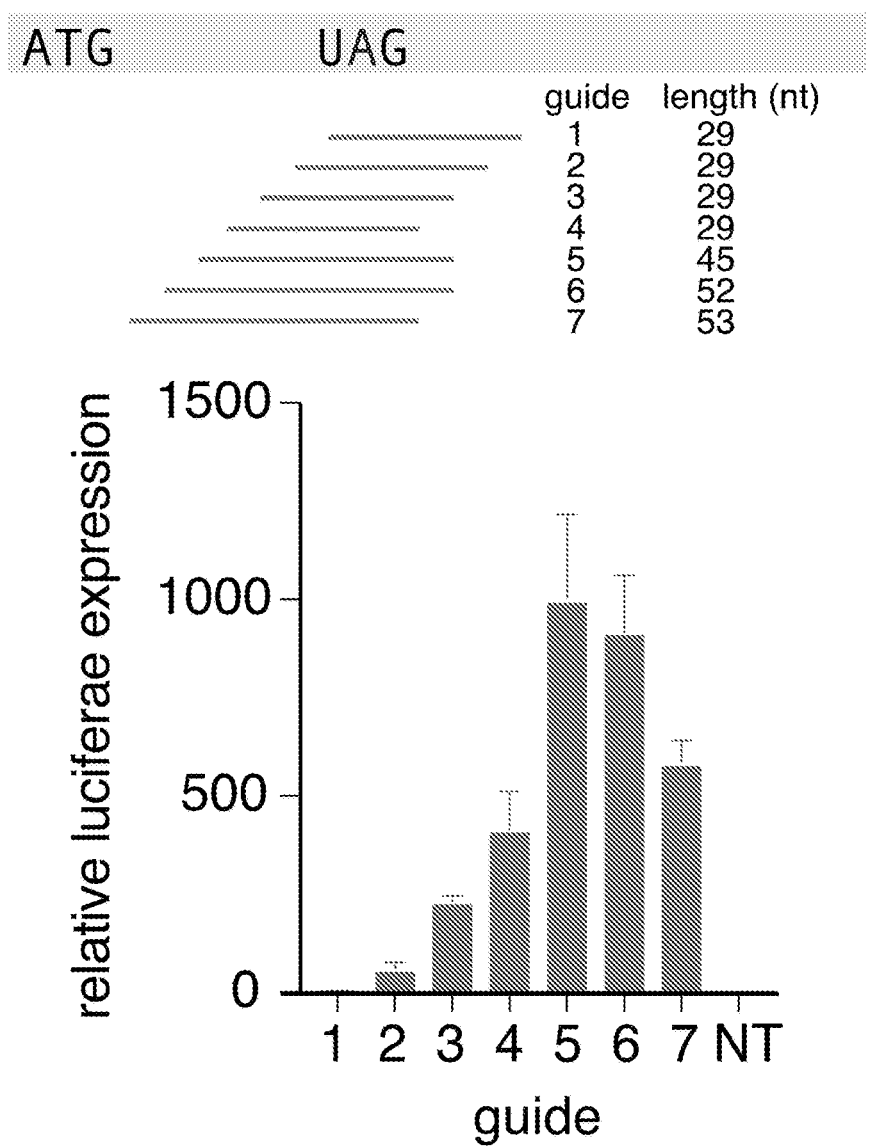
FIG. 3 Guide position and length optimization to restore luciferase expression.
Figure 5:
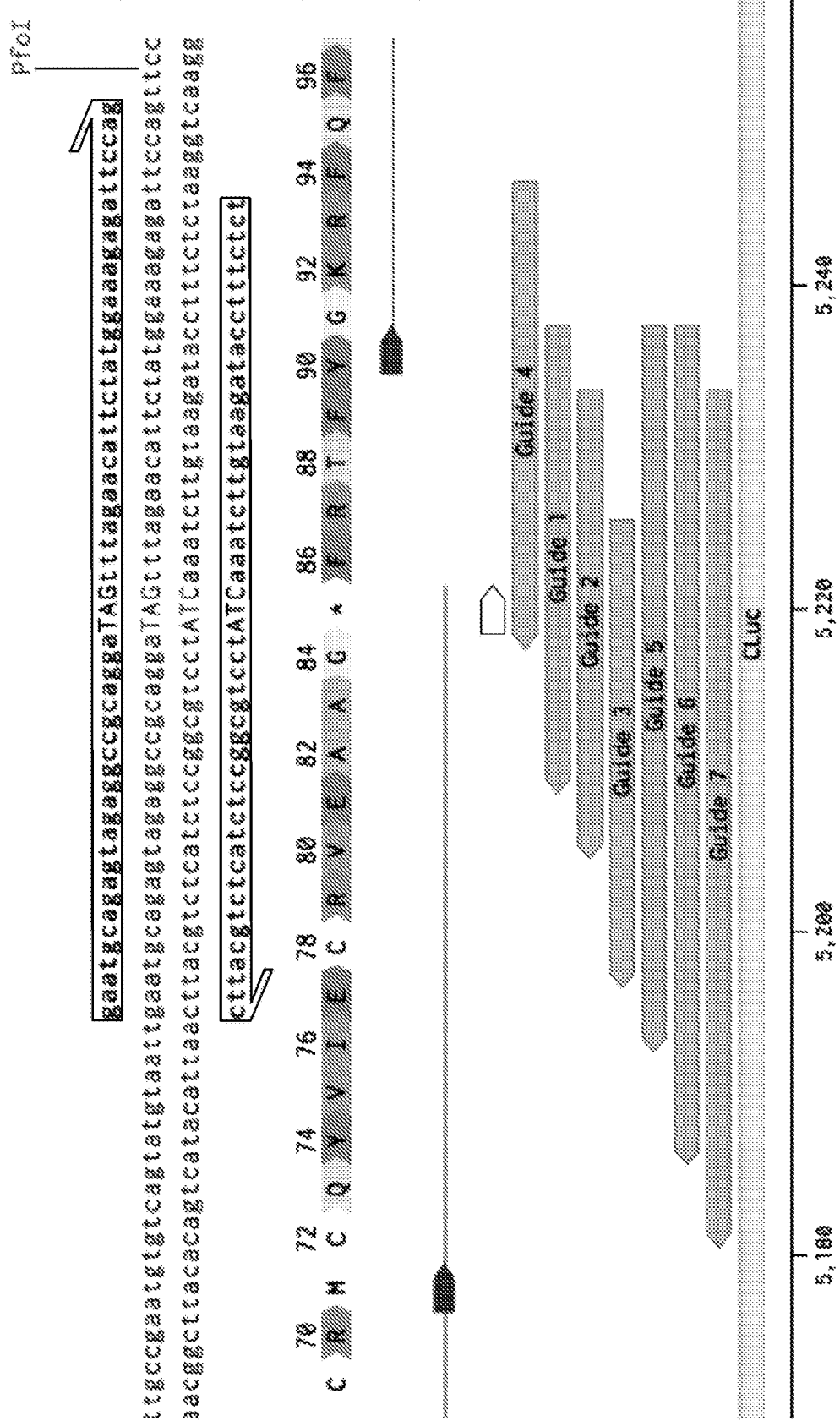
FIG. 5 Guides used in an exemplary embodiment (shown are SEQ ID Nos. 657-660 for the nucleotide sequences and SEQ ID NO: 696 for the amino acid sequence).
Figure 6:
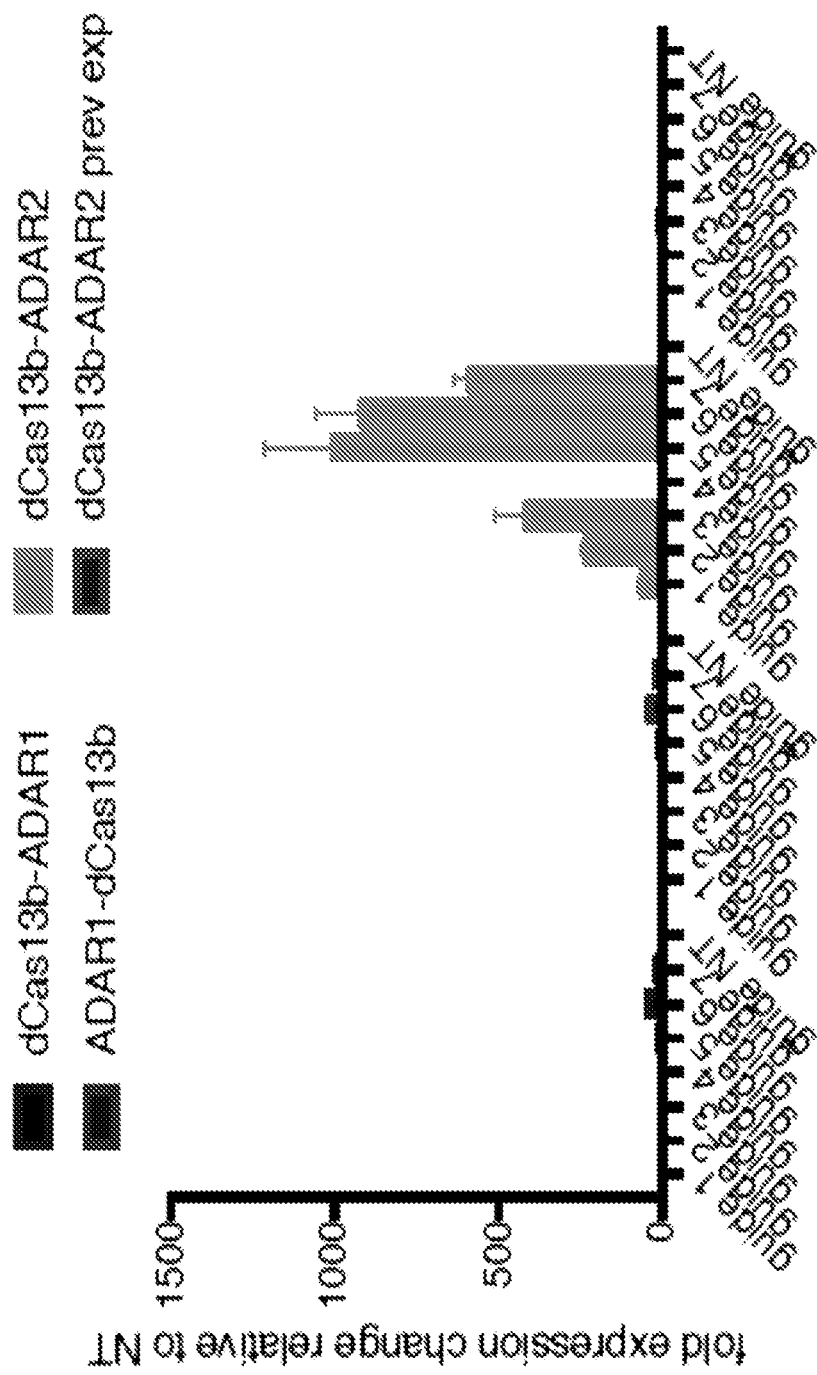
FIG. 6: Editing efficiency correlates to edited base being further away from the DR and having a long RNA duplex, which is accomplished by extending the guide length FIG. 7 Greater editing efficiency the further the editing site is away from the DR/protein binding area.
Figure 7:
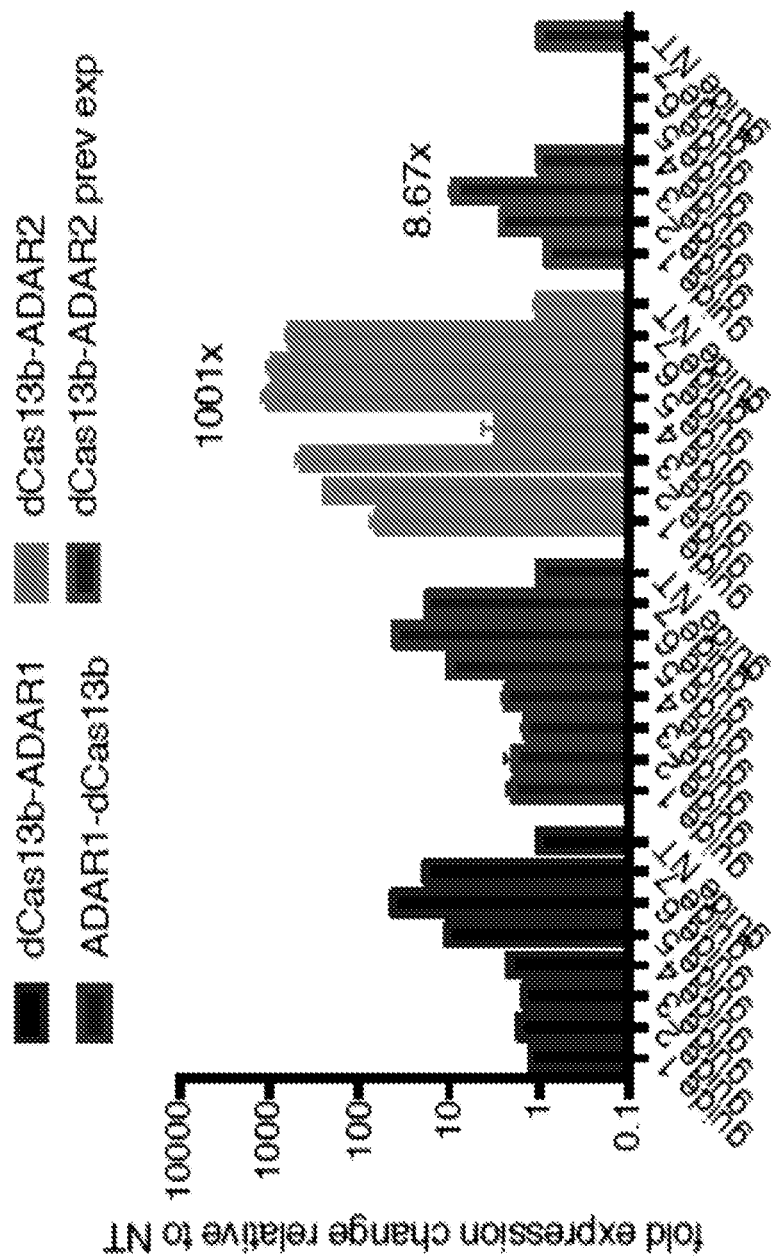
Figure 8:
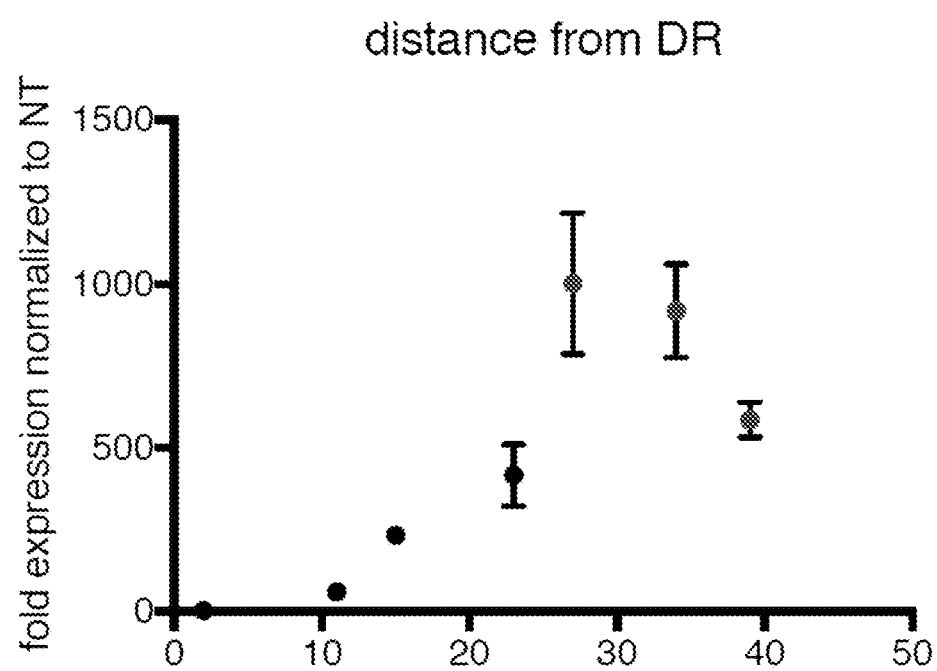
FIG. 8 Distance of edited site from DR
Figure 9A:
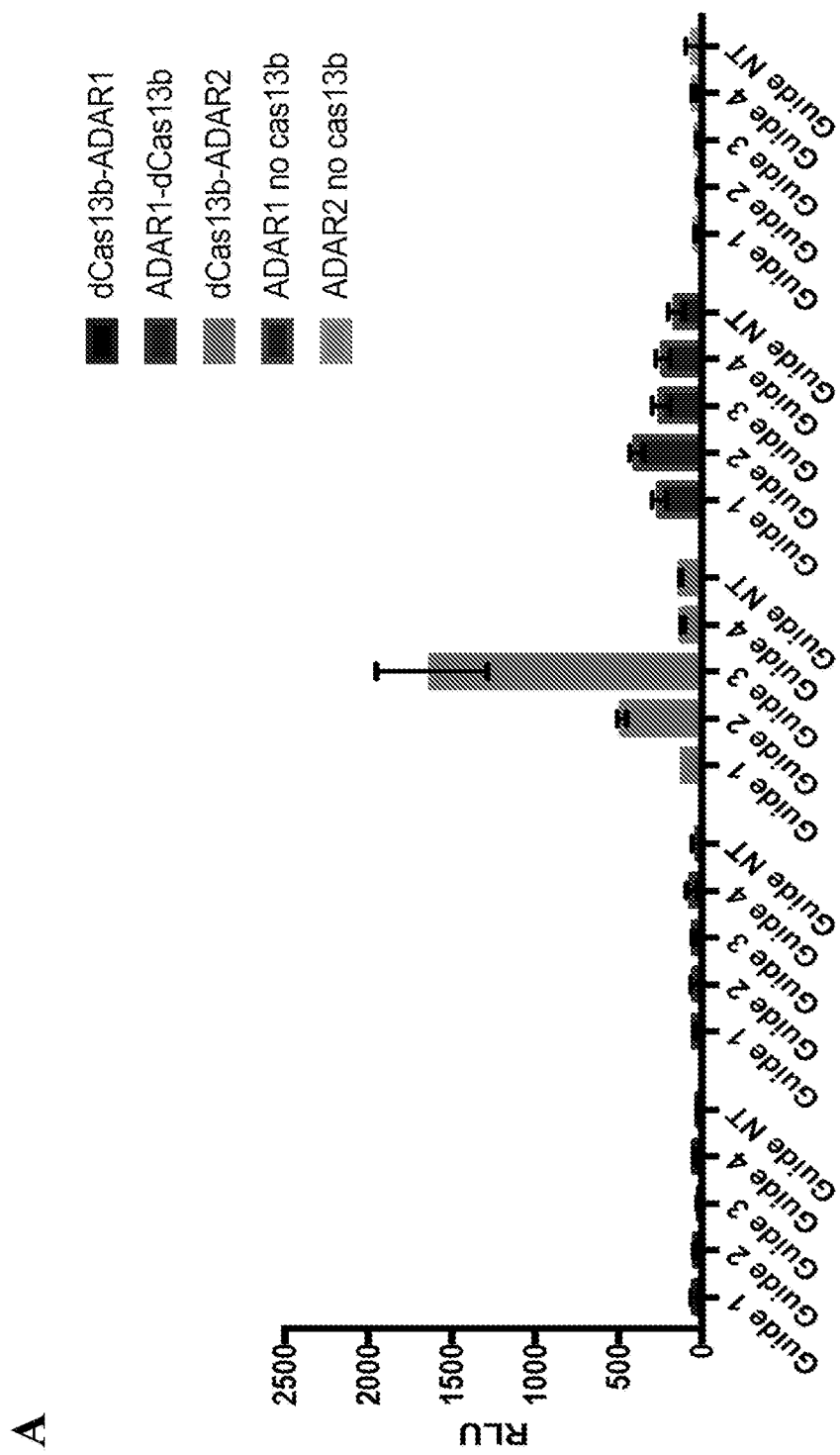
FIGS. 9A and 9B: Fused ADAR1 or ADAR2 to Cas13b12 (double R HEPN mutant) on the N or C-terminus. Guides are perfect matches to the stop codon in luciferase. Signal appears correlated with distance between edited base and 5' end of the guide, with shorter distances providing better editing.
Figure 9B:
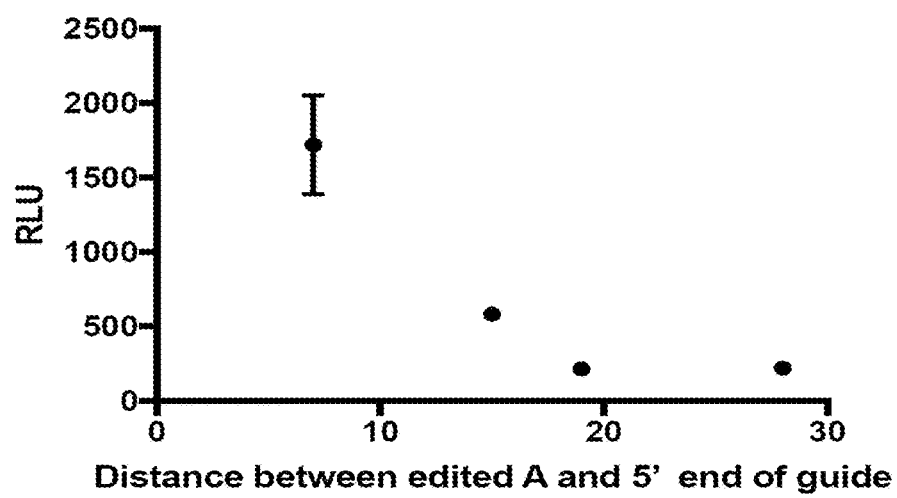

The figures herein are for illustrative purposes only and are not necessarily drawn to scale.

DETAILED DESCRIPTION

General Definitions

Unless defined otherwise, technical and scientific terms used herein have the same meaning as commonly understood by one of ordinary skill in the art to which this disclosure pertains. Definitions of common terms and techniques in molecular biology may be found in Molecular Cloning: A Laboratory Manual, 2nd edition (1989) (Sambrook, Fritsch, and Maniatis); Molecular Cloning: A Laboratory Manual, 4th edition (2012) (Green and Sambrook); Current Protocols in Molecular Biology (1987) (F. M.

Ausubel et al. eds.); the series Methods in Enzymology (Academic Press, Inc.): PCR 2: A Practical Approach (1995) (M. J. MacPherson, B. D. Hames, and G. R. Taylor eds.): Antibodies, A Laboratory Manual (1988) (Harlow and Lane, eds.): Antibodies A Laboratory Manual, 2nd edition 2013 (E. A. Greenfield ed.); Animal Cell Culture (1987) (R. I. Freshney, ed.); Benjamin Lewin, Genes IX, published by Jones and Bartlet, 2008 (ISBN 0763752223); Kendrew et al. (eds.), The Encyclopedia of Molecular Biology, published by Blackwell Science Ltd., 1994 (ISBN 0632021829); Robert A. Meyers (ed.), Molecular Biology and Biotechnology: a Comprehensive Desk Reference, published by VCH Publishers, Inc., 1995 (ISBN 9780471185710); Singleton et al., Dictionary of Microbiology and Molecular Biology 2nd ed., J. Wiley & Sons (New York, N.Y. 1994), March, Advanced Organic Chemistry Reactions, Mechanisms and Structure 4th ed., John Wiley & Sons (New York, N.Y. 1992); and Marten H. Hofker and Jan van Deursen, Transgenic Mouse Methods and Protocols, 2nd edition (2011).

Reference is made to U.S. Provisional 62/351,662 and 62/351,803, filed on Jun. 17, 2016, U.S. Provisional 62/376, 377, filed on Aug. 17, 2016, U.S. Provisional 62/410,366, filed Oct. 19, 2016, U.S. Provisional 62/432,240, filed Dec. 9, 2016, U.S. provisional 62/471,792 filed Mar. 15, 2017, and U.S. Provisional 62/484,786 filed Apr. 12, 2017. Reference is made to International PCT application PCT/US2017/038154, filed Jun. 19, 2017. Reference is made to U.S. Provisional 62/471,710, filed Mar. 15, 2017 (entitled, "Novel Cas13B Orthologues CRISPR Enzymes and Systems,". Reference is further made to U.S. Provisional 62/432,553, filed Dec. 9, 2016, U.S. Provisional 62/456,645, filed Feb. 8, 2017, and U.S. Provisional 62/471,930, filed Mar. 15, 2017 (entitled "CRISPR Effector System Based Diagnostics," and US Provisional To Be Assigned, filed Apr. 12, 2017 (entitled "CRISPR Effector System Based Diagnostics,".

As used herein, the singular forms "a", "an", and "the" include both singular and plural referents unless the context clearly dictates otherwise.

The term "optional" or "optionally" means that the subsequent described event, circumstance or substituent may or may not occur, and that the description includes instances where the event or circumstance occurs and instances where it does not.

The recitation of numerical ranges by endpoints includes all numbers and fractions subsumed within the respective ranges, as well as the recited endpoints.

The terms "about" or "approximately" as used herein when referring to a measurable value such as a parameter, an amount, a temporal duration, and the like, are meant to encompass variations of and from the specified value, such as variations of +/−10% or less, +/−5% or less, +/−1% or less, and +/−0.1% or less of and from the specified value, insofar such variations are appropriate to perform in the disclosed invention. It is to be understood that the value to which the modifier "about" or "approximately" refers is itself also specifically, and preferably, disclosed.

Reference throughout this specification to "one embodiment", "an embodiment," "an example embodiment," means that a particular feature, structure or characteristic described in connection with the embodiment is included in at least one embodiment of the present invention. Thus, appearances of the phrases "in one embodiment," "in an embodiment," or "an example embodiment" in various places throughout this specification are not necessarily all referring to the same embodiment, but may. Furthermore, the particular features, structures or characteristics may be combined in any suitable manner, as would be apparent to a person skilled in the art from this disclosure, in one or more embodiments. Furthermore, while some embodiments described herein include some but not other features included in other embodiments, combinations of features of different embodiments are meant to be within the scope of the invention. For example, in the appended claims, any of the claimed embodiments can be used in any combination.

C2c2 is now known as Cas13a. It will be understood that the term "C2c2" herein is used interchangeably with "Cas13a".

All publications, published patent documents, and patent applications cited herein are hereby incorporated by reference to the same extent as though each individual publication, published patent document, or patent application was specifically and individually indicated as being incorporated by reference.

Various embodiments are described hereinafter. It should be noted that the specific embodiments are not intended as an exhaustive description or as a limitation to the broader aspects discussed herein. One aspect described in conjunction with a particular embodiment is not necessarily limited to that embodiment and can be practiced with any other embodiment(s).

Overview

The embodiments disclosed herein provide systems, constructs, and methods for targeted base editing. In general the systems disclosed herein comprise a targeting component and a base editing component. The targeting component functions to specifically target the base editing component to a target nucleotide sequence in which one or more nucleotides are to be edited. The base editing component may then catalyze a chemical reaction to convert a first nucleotide in the target sequence to a second nucleotide. For example, the base editor may catalyze conversion of an adenine such that it is read as guanine by a cell's transcription or translation machinery, or vice versa. Likewise, the base editing component may catalyze conversion of cytidine to a uracil, or vice versa. In certain example embodiments, the base editor may be derived by starting with a known base editor, such as an adenine deaminase or cytidine deaminase, and modified using methods such as directed evolution to derive new functionalities. Directed evolution techniques are known in the art and may include those described in WO 2015/184016 "High-Throughput Assembly of Genetic Permutations."

In certain example embodiments, the adenosine deaminase protein is recruited to the target loci of interest by fusion or linkage to a RNA-binding protein or RNA-binding functional domain thereof. The RNA-binding protein may bind a sequence, motif, or structural feature of the at or adjacent to the target locus. A structural feature may include hairpins, tetraloops, or other secondary structural features of a nucleic acid. As used herein "adjacent" means within a distance and/or orientation of the target locus in which the adenosine deaminase can complete its base editing function. In certain example embodiments, the RNA-binding protein or functional domain thereof may bind a sequence, motif, or structural sequence of a guide molecule. The guide molecule comprises a sequence that hybridizes to the target loci of interest and thereby directs the adenosine deaminase to the target loci.

In certain example embodiments, the RNA-binding protein or functional domain thereof comprises a RNA recognition motif Example RNA-binding proteins comprising a RNA recognition motif include, but are not limited to, A2BP1; ACF; BOLL; BRUNOL4; BRUNOL5; BRUNOL6; CCBL2; CGI96; CIRBP; CNOT4; CPEB2; CPEB3; CPEB4; CPSF7; CSTF2; CSTF2T; CUGBP1; CUGBP2; D10S102; DAZ1; DA Z2; DAZ3; DAZ4; DAZAP1; DAZL; DNAJC17; DND1; EIF3S4; EIF3S9; EIF4B; EIF4H; ELA VL1; ELAVL2; ELAVL3; ELAVL4; ENOX1; ENOX2; EWSR1; FUS; FUSIP1; G3BP; G3BP1 G3BP2; GRSF1; HNRNPL; HNRPA0; HNRPA1; HNRPA2B1; HNRPA3; HNRPAB; HNRPC; THNRPCL1; HNRPD; HNRPDL; HNRPF; HNRPH1; HNRPH2; HNRPH3; HNRPL; HNRPLL; HNRPM; HNRPR; HRNBP1; HSU53209; HTATSF1; IGF2BP1; IGF2BP2; IGF2BP3; LARP7; MKI67IP; MSI1; MSI2; MSSP2; MTHFSD; MYEF2; NCBP2; NCL; NOL8; NONO; P14; PAB PC1; PABPC1L; PABPC3; PABPC4; PABPC5; PABPN1; POLDIP3; PPARGC1; PPARGC1A; PPARGC1B; PPIE; PPIL4; PPRC1; PSPC1; PTBP1; PTBP2; PUF60; RALY; RALYL; RAVER 1; RAVER2; RBM10; RBM11; RBM12; RBM12B; RBM14; RBM15; RBM15B; RBM16; RB M17; RBM18; RBM19; RBM22; RBM23; RBM24; RBM25; RBM26; RBM27; RBM28; RBM3; RBM32B; RBM33; RBM34; RBM35A; RBM35B; RBM38; RBM39; RBM4; RBM41; RBM4 2; RBM44; RBM45; RBM46; RBM47; RBM4B; RBM5; RBM7; RBM8A; RBM9; RBMS1; RB MS2; RBMS3; RBMX; RBMX2; RBMXL2; RBMY1A1; RBMY1B; RBMY1E; RBMY1F; RB MY2FP; RBPMS; RBPMS2; RDBP; RNPC3; RNPC4; RNPS1; ROD1; SAFB; SAFB2; SART3; SETD1A; SF3B14; SF3B4; SFPQ; SFRS1; SFRS10; SFRS11; SFRS12; SFRS15; SFRS2; SFR S2B; SFRS3; SFRS4; SFRS5; SFRS6; SFRS7; SFRS9; SLIRP; SLTM; SNRP70; SNRPA; SNR PB2; SPEN; SR140; SRRP35; SSB; SYNCRIP; TAF15; TARDBP; THOC4; TIA1; TIAL1; TN RC4; TNRC6C; TRA2A; TRSPAP1; TUT1; U1SNRNPBP; U2AF1; U2AF2; UHM1K1; ZCRB1; ZNF638; ZRSR1; and ZRSR2.

In certain example embodiments, the RNA-binding protein or function domain thereof may comprise a K homology domain. Example RNA-binding proteins comprising a K homology domain include, but are not limited to, AKAP1; ANKHD1; ANKRD17; ASCC1; BICC1; DDX43; DDX53; DPPA5; FMR1; FUBP1; FUBP3; FXR1; FXR2; GLD1; HDLBP; HNRPK; IGF2BP1; IGF2BP2; IGF2BP3; KHDRBS1; KHDRBS2; KHDRBS3; KHSRP; KRR1; MEX3A; MEX3B; MEX3C; MEX3D; NOVA1; NOVA2; PCBP1; PCBP2; PCBP3; PCBP4; PNO1; PNPT1; QKI; SF1; and TDRKH In certain example embodiments, the RNA-binding protein comprises a zinc finger motif RNA-binding proteins or functional domains thereof may comprise a Cys2-His2, Gag-knuckle, Treble-clef, Zinc ribbon, Zn2/Cys6 class motif.

In certain example embodiments, the RNA-binding protein may comprise a *Pumilio* homology domain.

In one aspect the present invention provides methods for targeted deamination of adenine in RNA, more particularly in an RNA sequence of interest. According to the methods of the invention, the adenosine deaminase (AD) protein is recruited specifically to the relevant Adenine in the RNA sequence of interest by a CRISPR-Cas complex which can specifically bind to a target sequence. In order to achieve this, the adenosine deaminase protein can either be covalently linked to the CRISPR-Cas enzyme or be provided as a separate protein, but adapted so as to ensure recruitment thereof to the CRISPR-Cas complex.

In particular embodiments, of the methods of the present invention, recruitment of the adenosine deaminase to the target locus is ensured by fusing the adenosine deaminase or catalytic domain thereof to the CRISPR-Cas protein, which is a Cas13 protein. Methods of generating a fusion protein from two separate proteins are known in the art and typically involve the use of spacers or linkers. The Cas13 protein can be fused to the adenosine deaminase protein or catalytic domain thereof on either the N- or C-terminal end thereof. In particular embodiments, the CRISPR-Cas protein is an inactive or dead Cas13 protein and is linked to the N-terminus of the deaminase protein or its catalytic domain.

The term "linker" as used in reference to a fusion protein refers to a molecule which joins the proteins to form a fusion protein. Generally, such molecules have no specific biological activity other than to join or to preserve some minimum distance or other spatial relationship between the proteins. However, in certain embodiments, the linker may be selected to influence some property of the linker and/or the fusion protein such as the folding, net charge, or hydrophobicity of the linker.

Suitable linkers for use in the methods of the present invention are well known to those of skill in the art and include, but are not limited to, straight or branched-chain carbon linkers, heterocyclic carbon linkers, or peptide linkers. However, as used herein the linker may also be a covalent bond (carbon-carbon bond or carbon-heteroatom bond). In particular embodiments, the linker is used to separate the CRISPR-Cas protein and the adenosine deaminase by a distance sufficient to ensure that each protein retains its required functional property. Preferred peptide linker sequences adopt a flexible extended conformation and do not exhibit a propensity for developing an ordered secondary structure. In certain embodiments, the linker can be a chemical moiety which can be monomeric, dimeric, multimeric or polymeric. Preferably, the linker comprises amino acids. Typical amino acids in flexible linkers include Gly, Asn and Ser. Accordingly, in particular embodiments, the linker comprises a combination of one or more of Gly, Asn and Ser amino acids. Other near neutral amino acids, such as Thr and Ala, also may be used in the linker sequence. Exemplary linkers are disclosed in Maratea et al. (1985), Gene 40: 39-46; Murphy et al. (1986) Proc. Nat'l. Acad. Sci. USA 83: 8258-62; U.S. Pat. Nos. 4,935,233; and 4,751,180. For example, GlySer linkers GGS, GGGS or GSG can be used. GGS, GSG, GGGS or GGGGS linkers can be used in repeats of 3 (such as (GGS)3 (SEQ ID No. 12), (GGGGS)3) or 5, 6, 7, 8 or even 12 (SEQ ID No. 13) or more, to provide suitable lengths. In particular embodiments, linkers such as (GGGGS)3 are preferably used herein. (GGGGS)6 (GGGGS)9 or (GGGGS)12 may preferably be used as alternatives. Other preferred alternatives are (GGGGS)1 (SEQ ID No 14), (GGGGS)2 (SEQ ID No. 15), (GGGGS)4, (GGGGS)5, (GGGGS)7, (GGGGS)8, (GGGGS)10, or (GGGGS)11. In yet a further embodiment, LEPGEKPYKCPECGKSFSQSGALTRHQRTHTR (SEQ ID No:11) is used as a linker. In yet an additional embodiment, the linker is XTEN linker. In particular embodiments, the CRISPR-cas protein is a Cas13 protein and is linked to the deaminase protein or its catalytic domain by means of an LEPGEKPYKCPECGKSFSQSGALTRHQRTHTR (SEQ ID No. 11) linker. In further particular embodiments, the Cas13 protein is linked C-terminally to the N-terminus of a deaminase protein or its catalytic domain by means of an LEPGEKPYKCPECGKSFSQSGALTRHQRTHTR (SEQ ID No. 11) linker. In addition, N- and C-terminal NLSs can also function as linker (e.g., PKKKRKVEAS-SPKKRKVEAS (SEQ ID No. 16)).

In particular embodiments of the methods of the present invention, the adenosine deaminase protein or catalytic domain thereof is delivered to the cell or expressed within the cell as a separate protein, but is modified so as to be able to link to either the Cas13 protein or the guide molecule. In particular embodiments, this is ensured by the use of orthogonal RNA-binding protein or adaptor protein/aptamer combinations that exist within the diversity of bacteriophage coat proteins. Examples of such coat proteins include but are not limited to: MS2, Qβ, F2, GA, fr, JP501, M12, R17, BZ13, JP34, JP500, KU1, M11, MX1, TW18, VK, SP, FI, ID2, NL95, TW19, AP205, φCb5, φCb8r, φCb12r, φCb23r, 7s and PRR1. Aptamers can be naturally occurring or synthetic oligonucleotides that have been engineered through repeated rounds of in vitro selection or SELEX (systematic evolution of ligands by exponential enrichment) to bind to a specific target.

In particular embodiments of the methods and systems of the present invention, the guide molecule is provided with one or more distinct RNA loop(s) or distinct sequence(s) that can recruit an adaptor protein. A guide molecule may be extended, without colliding with the Cas13 protein by the insertion of distinct RNA loop(s) or distinct sequence(s) that may recruit adaptor proteins that can bind to the distinct RNA loop(s) or distinct sequence(s). Examples of modified guides and their use in recruiting effector domains to the CRISPR-Cas complex are provided in Konermann (Nature 2015, 517(7536): 583-588). In particular embodiments, the aptamer is a minimal hairpin aptamer which selectively binds dimerized MS2 bacteriophage coat proteins in mammalian cells and is introduced into the guide molecule, such as in the stem-loop and/or in a tetraloop. In these embodiments, the adenosine deaminase protein is fused to MS2. The adenosine deaminase protein is then co-delivered together with the CRISPR-Cas protein and corresponding guide RNA.

The term "AD-functionalized CRISPR system" as used here refers to a nucleic acid targeting and editing system comprising (a) a CRISPR-Cas protein, more particularly a Cas13 protein which is catalytically inactive; (b) a guide molecule which comprises a guide sequence; and (c) an adenosine deaminase protein or catalytic domain thereof; wherein the adenosine deaminase protein or catalytic domain thereof is covalently or non-covalently linked to the CRISPR-Cas protein or the guide molecule or is adapted to link thereto after delivery; wherein the guide sequence is substantially complementary to the target sequence but comprises a non-pairing C corresponding to the A being targeted for deamination, resulting in an A-C mismatch in an RNA duplex formed by the guide sequence and the target sequence. For application in eukaryotic cells, the CRISPR-Cas protein and/or the adenosine deaminase are preferably NLS-tagged.

In some embodiments, the components (a), (b) and (c) are delivered to the cell as a ribonucleoprotein complex. The ribonucleoprotein complex can be delivered via one or more lipid nanoparticles.

In some embodiments, the components (a), (b) and (c) are delivered to the cell as one or more RNA molecules, such as one or more guide RNAs and one or more mRNA molecules encoding the CRISPR-Cas protein, the adenosine deaminase protein, and optionally the adaptor protein. The RNA molecules can be delivered via one or more lipid nanoparticles.

In some embodiments, the components (a), (b) and (c) are delivered to the cell as one or more DNA molecules. In some embodiments, the one or more DNA molecules are comprised within one or more vectors such as viral vectors (e.g., AAV). In some embodiments, the one or more DNA molecules comprise one or more regulatory elements operably configured to express the CRISPR-Cas protein, the guide molecule, and the adenosine deaminase protein or catalytic domain thereof, optionally wherein the one or more regulatory elements comprise inducible promoters.

In some embodiments, the CRISPR-Cas protein is a dead Cas13. In some embodiments, the dead Cas13 is a dead Cas13a protein which comprises one or more mutations in the HEPN domain. In some embodiments, the dead Cas13a comprises a mutation corresponding to R474A and R1046A in *Leptotrichia wadei* (LwaCas13a). In some embodiments, the dead Cas13 is a dead Cas13b protein which comprises one or more of R116A, H121A, R1177A, H1182A of a Cas13b protein originating from *Bergeyella zoohelcum* ATCC 43767 or amino acid positions corresponding thereto of a Cas13b ortholog.

In some embodiments of the guide molecule is capable of hybridizing with a target sequence comprising the Adenine to be deaminated within an RNA sequence to form an RNA duplex which comprises a non-pairing Cytosine opposite to said Adenine. Upon RNA duplex formation, the guide molecule forms a complex with the Cas13 protein and directs the complex to bind the RNA polynucleotide at the target RNA sequence of interest. Details on the aspect of the guide of the AD-functionalized CRISPR-Cas system are provided herein below.

In some embodiments, a Cas13 guide RNA having a canonical length of, e.g. LawCas13 is used to form an RNA duplex with the target DNA. In some embodiments, a Cas13 guide molecule longer than the canonical length for, e.g. LawCas13a is used to form an RNA duplex with the target DNA including outside of the Cas13-guide RNA-target DNA complex.

In at least a first design, the AD-functionalized CRISPR system comprises (a) an adenosine deaminase fused or linked to a CRISPR-Cas protein, wherein the CRISPR-Cas protein is catalytically inactive, and (b) a guide molecule comprising a guide sequence designed to introduce an A-C mismatch in an RNA duplex formed between the guide sequence and the target sequence. In some embodiments, the CRISPR-Cas protein and/or the adenosine deaminase are NLS-tagged, on either the N- or C-terminus or both.

In at least a second design, the AD-functionalized CRISPR system comprises (a) a CRISPR-Cas protein that is catalytically inactive, (b) a guide molecule comprising a guide sequence designed to introduce an A-C mismatch in an RNA duplex formed between the guide sequence and the target sequence, and an aptamer sequence (e.g., MS2 RNA motif or PP7 RNA motif) capable of binding to an adaptor protein (e.g., MS2 coating protein or PP7 coat protein), and (c) an adenosine deaminase fused or linked to an adaptor protein, wherein the binding of the aptamer and the adaptor protein recruits the adenosine deaminase to the RNA duplex formed between the guide sequence and the target sequence for targeted deamination at the A of the A-C mismatch. In some embodiments, the adaptor protein and/or the adenosine deaminase are NLS-tagged, on either the N- or C-terminus or both. The CRISPR-Cas protein can also be NLS-tagged.

The use of different aptamers and corresponding adaptor proteins also allows orthogonal gene editing to be implemented. In one example in which adenosine deaminase are used in combination with cytidine deaminase for orthogonal gene editing/deamination, sgRNA targeting different loci are modified with distinct RNA loops in order to recruit MS2-adenosine deaminase and PP7-cytidine deaminase (or PP7-adenosine deaminase and MS2-cytidine deaminase), respectively, resulting in orthogonal deamination of A or C at the target loci of interested, respectively. PP7 is the RNA-binding coat protein of the bacteriophage *Pseudomonas*. Like MS2, it binds a specific RNA sequence and secondary structure. The PP7 RNA-recognition motif is distinct from that of MS2. Consequently, PP7 and MS2 can be multiplexed to mediate distinct effects at different genomic loci simultaneously. For example, an sgRNA targeting locus A can be modified with MS2 loops, recruiting MS2-adenosine deaminase, while another sgRNA targeting locus B can be modified with PP7 loops, recruiting PP7-cytidine deaminase. In the same cell, orthogonal, locus-specific modifications are thus realized. This principle can be extended to incorporate other orthogonal RNA-binding proteins.

In at least a third design, the AD-functionalized CRISPR system comprises (a) an adenosine deaminase inserted into an internal loop or unstructured region of a CRISPR-Cas protein, wherein the CRISPR-Cas protein is catalytically inactive or a nickase, and (b) a guide molecule comprising a guide sequence designed to introduce an A-C mismatch in an RNA duplex formed between the guide sequence and the target sequence.

CRISPR-Cas protein split sites that are suitable for insertion of adenosine deaminase can be identified with the help of a crystal structure. One can use the crystal structure of an ortholog if a relatively high degree of homology exists between the ortholog and the intended CRISPR-Cas protein.

The split position may be located within a region or loop. Preferably, the split position occurs where an interruption of the amino acid sequence does not result in the partial or full destruction of a structural feature (e.g. alpha-helixes or β-sheets). Unstructured regions (regions that did not show up in the crystal structure because these regions are not structured enough to be "frozen" in a crystal) are often preferred options. The positions within the unstructured regions or outside loops may not need to be exactly the numbers provided above, but may vary by, for example 1, 2, 3, 4, 5, 6, 7, 8, 9, or even 10 amino acids either side of the position given above, depending on the size of the loop, so long as the split position still falls within an unstructured region of outside loop.

The AD-functionalized CRISPR system described herein can be used to target a specific Adenine within an RNA polynucleotide sequence for deamination. For example, the guide molecule can form a complex with the CRISPR-Cas protein and directs the complex to bind a target RNA sequence in the RNA polynucleotide of interest. Because the guide sequence is designed to have a non-pairing C, the RNA duplex formed between the guide sequence and the target sequence comprises an A-C mismatch, which directs the adenosine deaminase to contact and deaminate the A opposite to the non-pairing C, converting it to a Inosine (I). Since Inosine (I) base pairs with C and functions like G in cellular process, the targeted deamination of A described herein are useful for correction of undesirable G-A and C-T mutations, as well as for obtaining desirable A-G and T-C mutations.

In some embodiments, the AD-functionalized CRISPR system is used for targeted deamination in an RNA polynucleotide molecule in vitro. In some embodiments, the AD-functionalized CRISPR system is used for targeted deamination in a DNA molecule within a cell. The cell can be a eukaryotic cell, such as an animal cell, a mammalian cell, a human, or a plant cell.

The invention also relates to a method for treating or preventing a disease by the targeted deamination using the AD-functionalized CRISPR system, wherein the deamination of the A, which remedies a disease caused by transcripts containing a pathogenic G→A or C→T point mutation.

Examples of disease that can be treated or prevented with the present invention include cancer, Meier-Gorlin syndrome, Seckel syndrome 4, Joubert syndrome 5, Leber congenital amaurosis 10; Charcot-Marie-Tooth disease, type 2; Charcot-Marie-Tooth disease, type 2; Usher syndrome, type 2C; Spinocerebellar ataxia 28; Spinocerebellar ataxia 28; Spinocerebellar ataxia 28; Long QT syndrome 2; Sjögren-Larsson syndrome; Hereditary fructosuria; Hereditary fructosuria; Neuroblastoma; Neuroblastoma; Kallmann syndrome 1; Kallmann syndrome 1; Kallmann syndrome 1; Metachromatic leukodystrophy.

In particular embodiments, the invention thus comprises compositions for use in therapy. This implies that the methods can be performed in vivo, ex vivo or in vitro. In particular embodiments, the methods are not methods of treatment of the animal or human body or a method for modifying the germ line genetic identity of a human cell. In particular embodiments; when carrying out the method, the target RNA is not comprised within a human or animal cell. In particular embodiments, when the target is a human or animal target, the method is carried out ex vivo or in vitro.

The invention also relates to a method for knocking-out or knocking-down an undesirable activity of a gene, wherein the deamination of the A at the transcript of the gene results in a loss of function. For example, in one embodiment, the targeted deamination by the AD-functionalized CRISPR system can cause a nonsense mutation resulting in a premature stop codon in an endogenous gene. This may alter the expression of the endogenous gene and can lead to a desirable trait in the edited cell. In another embodiment, the targeted deamination by the AD-functionalized CRISPR system can cause a nonconservative missense mutation resulting in a code for a different amino acid residue in an endogenous gene. This may alter the function of the endogenous gene expressed and can also lead to a desirable trait in the edited cell.

The invention also relates to a modified cell obtained by the targeted deamination using the AD-functionalized CRISPR system, or progeny thereof, wherein the modified cell comprises an I or G in replace of the A in the target RNA sequence of interest compared to a corresponding cell before the targeted deamination. The modified cell can be a eukaryotic cell, such as an animal cell, a plant cell, an mammalian cell, or a human cell.

In some embodiments, the modified cell is a therapeutic T cell, such as a T cell suitable for CAR-T therapies. The modification may result in one or more desirable traits in the therapeutic T cell, including but not limited to, reduced expression of an immune checkpoint receptor (e.g., PDA, CTLA4), reduced expression of HLA proteins (e.g., B2M, HLA-A), and reduced expression of an endogenous TCR.

In some embodiments, the modified cell is an antibody-producing B cell. The modification may results in one or more desirable traits in the B cell, including but not limited to, enhanced antibody production.

The invention also relates to a modified non-human animal or a modified plant. The modified non-human animal can be a farm animal. The modified plant can be an agricultural crop.

The invention further relates to a method for cell therapy, comprising administering to a patient in need thereof the modified cell described herein, wherein the presence of the modified cell remedies a disease in the patient. In one embodiment, the modified cell for cell therapy is a CAR-T cell capable of recognizing and/or attacking a tumor cell. In another embodiment, the modified cell for cell therapy is a stem cell, such as a neural stem cell, a mesenchymal stem cell, a hematopoietic stem cell, or an iPSC cell.

The invention additionally relates to an engineered, non-naturally occurring system suitable for modifying an Adenine in a target locus of interest, comprising: a guide molecule which comprises a guide sequence, or a nucleotide sequence encoding the guide molecule; a CRISPR-Cas protein, or one or more nucleotide sequences encoding the CRISPR-Cas protein; an adenosine deaminase protein or catalytic domain thereof, or one or more nucleotide sequences encoding; wherein the adenosine deaminase protein or catalytic domain thereof is covalently or non-covalently linked to the CRISPR-Cas protein or the guide molecule or is adapted to link thereto after delivery; wherein the guide sequence is capable of hybridizing with a target sequence comprising an Adenine within an RNA polynucleotide of interest, but comprises a Cytosine at the position corresponding to the Adenine.

The invention additionally relates to an engineered, non-naturally occurring vector system suitable for modifying an Adenine in a target locus of interest, comprising one or more vectors comprising: a first regulatory element operably linked to one or more nucleotide sequences encoding a guide molecule which comprises a guide sequence; a second regulatory element operably linked to a nucleotide sequence encoding a CRISPR-Cas protein; and optionally a nucleotide sequence encoding an adenosine deaminase protein or catalytic domain thereof which is under control of the first or second regulatory element or operably linked to a third regulatory element; wherein, if the nucleotide sequence encoding an adenosine deaminase protein or catalytic domain thereof is operably linked to a third regulatory element, the adenosine deaminase protein or catalytic domain thereof is adapted to link to the guide molecule or the Crispr-Cas protein after expression; wherein the guide sequence is capable of hybridizing with a target sequence comprising an Adenine within the target locus, but comprises a Cytosine at the position corresponding to the Adenine; wherein components (a), (b) and (c) are located on the same or different vectors of the system.

The invention additionally relates to in vitro, ex vivo or in vivo host cell or cell line or progeny thereof comprising the engineered, non-naturally occurring system or vector system described herein. The host cell can be a eukaryotic cell, such as an animal cell, a plant cell, an mammalian cell, or a human cell.

Adenosine Deaminase

The term "adenosine deaminase" or "adenosine deaminase protein" as used herein refers to a protein, a polypeptide, or one or more functional domain(s) of a protein or a polypeptide that is capable of catalyzing a hydrolytic deamination reaction that converts an adenine (or an adenine moiety of a molecule) to a hypoxanthine (or a hypoxanthine moiety of a molecule), as shown below. In some embodiments, the adenine-containing molecule is an adenosine (A), and the hypoxanthine-containing molecule is an inosine (I). The adenine-containing molecule can be deoxyribonucleic acid (DNA) or ribonucleic acid (RNA).

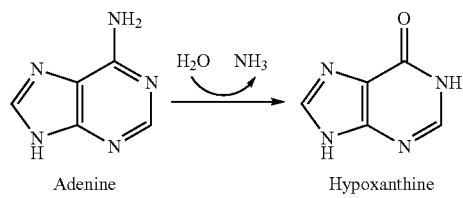

Adenine            Hypoxanthine

According to the present disclosure, adenosine deaminases that can be used in connection with the present disclosure include, but are not limited to, members of the enzyme family known as adenosine deaminases that act on RNA (ADARs), members of the enzyme family known as adenosine deaminases that act on tRNA (ADATs), and other adenosine deaminase domain-containing (ADAD) family members. According to the present disclosure, the adenosine deaminase is capable of targeting adenine in a RNA/DNA and RNA duplexes. Indeed, Zheng et al. (Nucleic Acids Res. 2017, 45(6): 3369-3377) demonstrate that ADARs can carry out adenosine to inosine editing reactions on RNA/DNA and RNA/RNA duplexes. In particular embodiments, the adenosine deaminase has been modified to increase its ability to edit DNA in a RNA/DNAn RNA duplex as detailed herein below.

In some embodiments, the adenosine deaminase is derived from one or more metazoa species, including but not limited to, mammals, birds, frogs, squids, fish, flies and worms. In some embodiments, the adenosine deaminase is a human, squid or *Drosophila* adenosine deaminase.

In some embodiments, the adenosine deaminase is a human ADAR, including hADAR1, hADAR2, hADAR3. In some embodiments, the adenosine deaminase is a *Caenorhabditis elegans* ADAR protein, including ADR-1 and ADR-2. In some embodiments, the adenosine deaminase is a *Drosophila* ADAR protein, including dAdar. In some embodiments, the adenosine deaminase is a squid *Loligo pealeii* ADAR protein, including sqADAR2a and sqADAR2b. In some embodiments, the adenosine deaminase is a human ADAT protein. In some embodiments, the adenosine deaminase is a *Drosophila* ADAT protein. In some embodiments, the adenosine deaminase is a human ADAD protein, including TENR (hADAD1) and TENRL (hADAD2).

In some embodiments, the adenosine deaminase protein recognizes and converts one or more target adenosine residue(s) in a double-stranded nucleic acid substrate into inosine residues (s). In some embodiments, the double-stranded nucleic acid substrate is a RNA-DNA hybrid duplex. In some embodiments, the adenosine deaminase protein recognizes a binding window on the double-stranded substrate. In some embodiments, the binding window contains at least one target adenosine residue(s). In some embodiments, the binding window is in the range of about 3 bp to about 100 bp. In some embodiments, the binding window is in the range of about 5 bp to about 50 bp. In some embodiments, the binding window is in the range of about 10 bp to about 30 bp. In some embodiments, the binding window is about 1 bp, 2 bp, 3 bp, 5 bp, 7 bp, 10 bp, 15 bp, 20 bp, 25 bp, 30 bp, 40 bp, 45 bp, 50 bp, 55 bp, 60 bp, 65 bp, 70 bp, 75 bp, 80 bp, 85 bp, 90 bp, 95 bp, or 100 bp.

In some embodiments, the adenosine deaminase protein comprises one or more deaminase domains. Not intended to be bound by theory, it is contemplated that the deaminase domain functions to recognize and convert one or more target adenosine (A) residue(s) contained in a double-stranded nucleic acid substrate into inosine (I) residues (s). In some embodiments, the deaminase domain comprises an active center. In some embodiments, the active center comprises a zinc ion. In some embodiments, during the A-to-I editing process, base pairing at the target adenosine residue is disrupted, and the target adenosine residue is "flipped" out of the double helix to become accessible by the adenosine deaminase. In some embodiments, amino acid residues in or near the active center interact with one or more nucleotide(s) 5' to a target adenosine residue. In some embodiments, amino acid residues in or near the active center interact with one or more nucleotide(s) 3' to a target adenosine residue. In some embodiments, amino acid residues in or near the active center further interact with the nucleotide complementary to the target adenosine residue on the opposite strand. In some embodiments, the amino acid residues form hydrogen bonds with the 2' hydroxyl group of the nucleotides.

In some embodiments, the adenosine deaminase comprises human ADAR2 full protein (hADAR2) or the deaminase domain thereof (hADAR2-D). In some embodiments, the adenosine deaminase is an ADAR family member that is homologous to hADAR2 or hADAR2-D.

Particularly, in some embodiments, the homologous ADAR protein is human ADAR1 (hADAR1) or the deaminase domain thereof (hADAR1-D). In some embodiments, glycine 1007 of hADAR1-D corresponds to glycine 487 hADAR2-D, and glutamic Acid 1008 of hADAR1-D corresponds to glutamic acid 488 of hADAR2-D.

In some embodiments, the adenosine deaminase comprises the wild-type amino acid sequence of hADAR2-D. In some embodiments, the adenosine deaminase comprises one or more mutations in the hADAR2-D sequence, such that the editing efficiency, and/or substrate editing preference of hADAR2-D is changed according to specific needs.

Certain mutations of hADAR1 and hADAR2 proteins have been described in Kuttan et al., Proc Natl Acad Sci USA. (2012) 109(48):E3295-304; Want et al. ACS Chem Biol. (2015) 10(11):2512-9; and Zheng et al. Nucleic Acids Res. (2017) 45(6):3369-337, each of which is incorporated herein by reference in its entirety.

In some embodiments, the adenosine deaminase comprises a mutation at glycine336 of the hADAR2-D amino acid sequence, or a corresponding position in a homologous ADAR protein. In some embodiments, the glycine residue at position 336 is replaced by an aspartic acid residue (G336D).

In some embodiments, the adenosine deaminase comprises a mutation at Glycine487 of the hADAR2-D amino acid sequence, or a corresponding position in a homologous ADAR protein. In some embodiments, the glycine residue at position 487 is replaced by a non-polar amino acid residue with relatively small side chains. For example, in some embodiments, the glycine residue at position 487 is replaced by an alanine residue (G487A). In some embodiments, the glycine residue at position 487 is replaced by a valine residue (G487V). In some embodiments, the glycine residue at position 487 is replaced by an amino acid residue with relatively large side chains. In some embodiments, the glycine residue at position 487 is replaced by a arginine residue (G487R). In some embodiments, the glycine residue at position 487 is replaced by a lysine residue (G487K). In some embodiments, the glycine residue at position 487 is replaced by a tryptophan residue (G487W). In some embodiments, the glycine residue at position 487 is replaced by a tyrosine residue (G487Y).

In some embodiments, the adenosine deaminase comprises a mutation at glutamic acid488 of the hADAR2-D amino acid sequence, or a corresponding position in a homologous ADAR protein. In some embodiments, the glutamic acid residue at position 488 is replaced by a glutamine residue (E488Q). In some embodiments, the glutamic acid residue at position 488 is replaced by a histidine residue (E488H). In some embodiments, the glutamic acid residue at position 488 is replace by an arginine residue (E488R). In some embodiments, the glutamic acid residue at position 488 is replace by a lysine residue (E488K). In some embodiments, the glutamic acid residue at position 488 is replace by an asparagine residue (E488N). In some embodiments, the glutamic acid residue at position 488 is replace by an alanine residue (E488A). In some embodiments, the glutamic acid residue at position 488 is replace by a Methionine residue (E488M). In some embodiments, the glutamic acid residue at position 488 is replace by a serine residue (E488S). In some embodiments, the glutamic acid residue at position 488 is replace by a phenylalanine residue (E488F). In some embodiments, the glutamic acid residue at position 488 is replace by a lysine residue (E488L). In some embodiments, the glutamic acid residue at position 488 is replace by a tryptophan residue (E488W).

In some embodiments, the adenosine deaminase comprises a mutation at threonine490 of the hADAR2-D amino acid sequence, or a corresponding position in a homologous ADAR protein. In some embodiments, the threonine residue at position 490 is replaced by a cysteine residue (T490C). In some embodiments, the threonine residue at position 490 is replaced by a serine residue (T490S). In some embodiments, the threonine residue at position 490 is replaced by an alanine residue (T490A). In some embodiments, the threonine residue at position 490 is replaced by a phenylalanine residue (T490F). In some embodiments, the threonine residue at position 490 is replaced by a tyrosine residue (T490Y). In some embodiments, the threonine residue at position 490 is replaced by a serine residue (T490R). In some embodiments, the threonine residue at position 490 is replaced by an alanine residue (T490K). In some embodiments, the threonine residue at position 490 is replaced by a phenylalanine residue (T490P). In some embodiments, the threonine residue at position 490 is replaced by a tyrosine residue (T490E).

In some embodiments, the adenosine deaminase comprises a mutation at valine493 of the hADAR2-D amino acid sequence, or a corresponding position in a homologous ADAR protein. In some embodiments, the valine residue at position 493 is replaced by an alanine residue (V493A). In some embodiments, the valine residue at position 493 is replaced by a serine residue (V493S). In some embodiments, the valine residue at position 493 is replaced by a threonine residue (V493T). In some embodiments, the valine residue at position 493 is replaced by an arginine residue (V493R). In some embodiments, the valine residue at position 493 is replaced by an aspartic acid residue (V493D). In some embodiments, the valine residue at position 493 is replaced by a proline residue (V493P). In some embodiments, the valine residue at position 493 is replaced by a glycine residue (V493G).

In some embodiments, the adenosine deaminase comprises a mutation at alanine589 of the hADAR2-D amino acid sequence, or a corresponding position in a homologous ADAR protein. In some embodiments, the alanine residue at position 589 is replaced by a valine residue (A589V).

In some embodiments, the adenosine deaminase comprises a mutation at asparagine597 of the hADAR2-D amino acid sequence, or a corresponding position in a homologous ADAR protein. In some embodiments, the asparagine residue at position 597 is replaced by a lysine residue (N597K). In some embodiments, the adenosine deaminase comprises a mutation at position 597 of the amino acid sequence, which has an asparagine residue in the wild type sequence. In some embodiments, the asparagine residue at position 597 is replaced by an arginine residue (N597R). In some embodiments, the adenosine deaminase comprises a mutation at position 597 of the amino acid sequence, which has an asparagine residue in the wild type sequence. In some embodiments, the asparagine residue at position 597 is replaced by an alanine residue (N597A). In some embodiments, the adenosine deaminase comprises a mutation at position 597 of the amino acid sequence, which has an asparagine residue in the wild type sequence. In some embodiments, the asparagine residue at position 597 is replaced by a glutamic acid residue (N597E). In some embodiments, the adenosine deaminase comprises a mutation at position 597 of the amino acid sequence, which has an asparagine residue in the wild type sequence. In some embodiments, the asparagine residue at position 597 is replaced by a histidine residue (N597H). In some embodiments, the adenosine deaminase comprises a mutation at position 597 of the amino acid sequence, which has an asparagine residue in the wild type sequence. In some embodiments, the asparagine residue at position 597 is replaced by a glycine residue (N597G). In some embodiments, the adenosine deaminase comprises a mutation at position 597 of the amino acid sequence, which has an asparagine residue in the wild type sequence. In some embodiments, the asparagine residue at position 597 is replaced by a tyrosine residue (N597Y). In some embodiments, the asparagine residue at position 597 is replaced by a phenylalanine residue (N597F).

In some embodiments, the adenosine deaminase comprises a mutation at serine599 of the hADAR2-D amino acid sequence, or a corresponding position in a homologous ADAR protein. In some embodiments, the serine residue at position 599 is replaced by a threonine residue (S599T).

In some embodiments, the adenosine deaminase comprises a mutation at asparagine613 of the hADAR2-D amino acid sequence, or a corresponding position in a homologous ADAR protein. In some embodiments, the asparagine residue at position 613 is replaced by a lysine residue (N613K). In some embodiments, the adenosine deaminase comprises a mutation at position 613 of the amino acid sequence, which has an asparagine residue in the wild type sequence. In some embodiments, the asparagine residue at position 613 is replaced by an arginine residue (N613R). In some embodiments, the adenosine deaminase comprises a mutation at position 613 of the amino acid sequence, which has an asparagine residue in the wild type sequence. In some embodiments, the asparagine residue at position 613 is replaced by an alanine residue (N613A) In some embodiments, the adenosine deaminase comprises a mutation at position 613 of the amino acid sequence, which has an asparagine residue in the wild type sequence. In some embodiments, the asparagine residue at position 613 is replaced by a glutamic acid residue (N613E).

In some embodiments, to improve editing efficiency, the adenosine deaminase may comprise one or more of the mutations: G336D, G487A, G487V, E488Q, E488H, E488R, E488N, E488A, E488S, E488M, T490C, T490S, V493T, V493S, V493A, V493R, V493D, V493P, V493G, N597K, N597R, N597A, N597E, N597H, N597G, N597Y, A589V, S599T, N613K, N613R, N613A, N613E, based on amino acid sequence positions of hADAR2-D, and mutations in a homologous ADAR protein corresponding to the above.

In some embodiments, to reduce editing efficiency, the adenosine deaminase may comprise one or more of the mutations: E488F, E488L, E488W, T490A, T490F, T490Y, T490R, T490K, T490P, T490E, N597F, based on amino acid sequence positions of hADAR2-D, and mutations in a homologous ADAR protein corresponding to the above. In particular embodiments, it can be of interest to use an adenosine deaminase enzyme with reduced efficacy to reduce off-target effects.

In some embodiments, to reduce off-target effects, the adenosine deaminase comprises one or more of mutations at R348, V351, T375, K376, E396, C451, R455, N473, R474, K475, R477, R481, S486, E488, T490, S495, R510, based on amino acid sequence positions of hADAR2-D, and mutations in a homologous ADAR protein corresponding to the above. In some embodiments, the adenosine deaminase comprises mutation at E488 and one or more additional positions selected from R348, V351, T375, K376, E396, C451, R455, N473, R474, K475, R477, R481, S486, T490, S495, R510. In some embodiments, the adenosine deaminase comprises mutation at T375, and optionally at one or more additional positions. In some embodiments, the adenosine deaminase comprises mutation at N473, and optionally at one or more additional positions. In some embodiments, the adenosine deaminase comprises mutation at V351, and optionally at one or more additional positions. In some embodiments, the adenosine deaminase comprises mutation at E488 and T375, and optionally at one or more additional positions. In some embodiments, the adenosine deaminase comprises mutation at E488 and N473, and optionally at one or more additional positions. In some embodiments, the adenosine deaminase comprises mutation E488 and V351, and optionally at one or more additional positions. In some embodiments, the adenosine deaminase comprises mutation at E488 and one or more of T375, N473, and V351.

In some embodiments, to reduce off-target effects, the adenosine deaminase comprises one or more of mutations selected from R348E, V351L, T375G, T375S, R455G, R455S, R455E, N473D, R474E, K475Q, R477E, R481E, S486T, E488Q, T490A, T490S, S495T, and R510E, based on amino acid sequence positions of hADAR2-D, and mutations in a homologous ADAR protein corresponding to the above. In some embodiments, the adenosine deaminase comprises mutation E488Q and one or more additional mutations selected from R348E, V351L, T375G, T375S, R455G, R455S, R455E, N473D, R474E, K475Q, R477E, R481E, S486T, T490A, T490S, S495T, and R510E. In some embodiments, the adenosine deaminase comprises mutation T375G or T375S, and optionally one or more additional mutations. In some embodiments, the adenosine deaminase comprises mutation N473D, and optionally one or more additional mutations. In some embodiments, the adenosine deaminase comprises mutation V351L, and optionally one or more additional mutations. In some embodiments, the adenosine deaminase comprises mutation E488Q, and T375G or T375G, and optionally one or more additional mutations. In some embodiments, the adenosine deaminase comprises mutation E488Q and N473D, and optionally one or more additional mutations. In some embodiments, the adenosine deaminase comprises mutation E488Q and V351L, and optionally one or more additional mutations. In some embodiments, the adenosine deaminase comprises mutation E488Q and one or more of T375G/S, N473D and V351L.

Crystal structures of the human ADAR2 deaminase domain bound to duplex RNA reveal a protein loop that binds the RNA on the 5' side of the modification site. This 5' binding loop is one contributor to substrate specificity differences between ADAR family members. See Wang et al., Nucleic Acids Res., 44(20):9872-9880 (2016), the content of which is incorporated herein by reference in its entirety. In addition, an ADAR2-specific RNA-binding loop was identified near the enzyme active site. See Mathews et al., Nat. Struct. Mol. Biol., 23(5):426-33 (2016), the content of which is incorporated herein by reference in its entirety.

In some embodiments, the adenosine deaminase comprises one or more mutations in the RNA binding loop to improve editing specificity and/or efficiency.

In some embodiments, the adenosine deaminase comprises a mutation at alanine454 of the hADAR2-D amino acid sequence, or a corresponding position in a homologous ADAR protein. In some embodiments, the alanine residue at position 454 is replaced by a serine residue (A454S). In some embodiments, the alanine residue at position 454 is replaced by a cysteine residue (A454C). In some embodiments, the alanine residue at position 454 is replaced by an aspartic acid residue (A454D).

In some embodiments, the adenosine deaminase comprises a mutation at arginine455 of the hADAR2-D amino acid sequence, or a corresponding position in a homologous ADAR protein. In some embodiments, the arginine residue at position 455 is replaced by an alanine residue (R455A). In some embodiments, the arginine residue at position 455 is replaced by a valine residue (R455V). In some embodiments, the arginine residue at position 455 is replaced by a histidine residue (R455H). In some embodiments, the arginine residue at position 455 is replaced by a glycine residue (R455G). In some embodiments, the arginine residue at position 455 is replaced by a serine residue (R455S). In some embodiments, the arginine residue at position 455 is replaced by a glutamic acid residue (R455E).

In some embodiments, the adenosine deaminase comprises a mutation at isoleucine456 of the hADAR2-D amino acid sequence, or a corresponding position in a homologous ADAR protein. In some embodiments, the isoleucine residue at position 456 is replaced by a valine residue (I456V). In some embodiments, the isoleucine residue at position 456 is replaced by a leucine residue (I456L). In some embodiments, the isoleucine residue at position 456 is replaced by an aspartic acid residue (I456D).

In some embodiments, the adenosine deaminase comprises a mutation at phenylalanine457 of the hADAR2-D amino acid sequence, or a corresponding position in a homologous ADAR protein. In some embodiments, the phenylalanine residue at position 457 is replaced by a tyrosine residue (F457Y). In some embodiments, the phenylalanine residue at position 457 is replaced by an arginine residue (F457R). In some embodiments, the phenylalanine residue at position 457 is replaced by a glutamic acid residue (F457E).

In some embodiments, the adenosine deaminase comprises a mutation at serine458 of the hADAR2-D amino acid sequence, or a corresponding position in a homologous ADAR protein. In some embodiments, the serine residue at position 458 is replaced by a valine residue (S458V). In some embodiments, the serine residue at position 458 is replaced by a phenylalanine residue (S458F). In some embodiments, the serine residue at position 458 is replaced by a proline residue (S458P).

In some embodiments, the adenosine deaminase comprises a mutation at proline459 of the hADAR2-D amino acid sequence, or a corresponding position in a homologous ADAR protein. In some embodiments, the proline residue at position 459 is replaced by a cysteine residue (P459C). In some embodiments, the proline residue at position 459 is replaced by a histidine residue (P459H). In some embodiments, the proline residue at position 459 is replaced by a tryptophan residue (P459W).

In some embodiments, the adenosine deaminase comprises a mutation at histidine460 of the hADAR2-D amino acid sequence, or a corresponding position in a homologous ADAR protein. In some embodiments, the histidine residue at position 460 is replaced by an arginine residue (H460R). In some embodiments, the histidine residue at position 460 is replaced by an isoleucine residue (H460I). In some embodiments, the histidine residue at position 460 is replaced by a proline residue (H460P).

In some embodiments, the adenosine deaminase comprises a mutation at proline462 of the hADAR2-D amino acid sequence, or a corresponding position in a homologous ADAR protein. In some embodiments, the proline residue at position 462 is replaced by a serine residue (P462S). In some embodiments, the proline residue at position 462 is replaced by a tryptophan residue (P462W). In some embodiments, the proline residue at position 462 is replaced by a glutamic acid residue (P462E).

In some embodiments, the adenosine deaminase comprises a mutation at aspartic acid469 of the hADAR2-D amino acid sequence, or a corresponding position in a homologous ADAR protein. In some embodiments, the aspartic acid residue at position 469 is replaced by a glutamine residue (D469Q). In some embodiments, the aspartic acid residue at position 469 is replaced by a serine residue (D469S). In some embodiments, the aspartic acid residue at position 469 is replaced by a tyrosine residue (D469Y).

In some embodiments, the adenosine deaminase comprises a mutation at arginine470 of the hADAR2-D amino acid sequence, or a corresponding position in a homologous ADAR protein. In some embodiments, the arginine residue at position 470 is replaced by an alanine residue (R470A). In some embodiments, the arginine residue at position 470 is replaced by an isoleucine residue (R470I). In some embodiments, the arginine residue at position 470 is replaced by an aspartic acid residue (R470D).

In some embodiments, the adenosine deaminase comprises a mutation at histidine471 of the hADAR2-D amino acid sequence, or a corresponding position in a homologous ADAR protein. In some embodiments, the histidine residue at position 471 is replaced by a lysine residue (H471K). In some embodiments, the histidine residue at position 471 is replaced by a threonine residue (H471T). In some embodiments, the histidine residue at position 471 is replaced by a valine residue (H471V).

In some embodiments, the adenosine deaminase comprises a mutation at proline472 of the hADAR2-D amino acid sequence, or a corresponding position in a homologous ADAR protein. In some embodiments, the proline residue at position 472 is replaced by a lysine residue (P472K). In some embodiments, the proline residue at position 472 is replaced by a threonine residue (P472T). In some embodiments, the proline residue at position 472 is replaced by an aspartic acid residue (P472D).

In some embodiments, the adenosine deaminase comprises a mutation at asparagine473 of the hADAR2-D amino acid sequence, or a corresponding position in a homologous ADAR protein. In some embodiments, the asparagine residue at position 473 is replaced by an arginine residue (N473R). In some embodiments, the asparagine residue at position 473 is replaced by a tryptophan residue (N473W). In some embodiments, the asparagine residue at position 473 is replaced by a proline residue (N473P). In some embodiments, the asparagine residue at position 473 is replaced by an aspartic acid residue (N473D).

In some embodiments, the adenosine deaminase comprises a mutation at arginine474 of the hADAR2-D amino acid sequence, or a corresponding position in a homologous ADAR protein. In some embodiments, the arginine residue at position 474 is replaced by a lysine residue (R474K). In some embodiments, the arginine residue at position 474 is replaced by a glycine residue (R474G). In some embodiments, the arginine residue at position 474 is replaced by an aspartic acid residue (R474D). In some embodiments, the arginine residue at position 474 is replaced by a glutamic acid residue (R474E).

In some embodiments, the adenosine deaminase comprises a mutation at lysine475 of the hADAR2-D amino acid sequence, or a corresponding position in a homologous ADAR protein. In some embodiments, the lysine residue at position 475 is replaced by a glutamine residue (K475Q). In some embodiments, the lysine residue at position 475 is replaced by an asparagine residue (K475N). In some embodiments, the lysine residue at position 475 is replaced by an aspartic acid residue (K475D).

In some embodiments, the adenosine deaminase comprises a mutation at alanine476 of the hADAR2-D amino acid sequence, or a corresponding position in a homologous ADAR protein. In some embodiments, the alanine residue at position 476 is replaced by a serine residue (A476S). In some embodiments, the alanine residue at position 476 is replaced by an arginine residue (A476R). In some embodiments, the alanine residue at position 476 is replaced by a glutamic acid residue (A476E).

In some embodiments, the adenosine deaminase comprises a mutation at arginine477 of the hADAR2-D amino acid sequence, or a corresponding position in a homologous ADAR protein. In some embodiments, the arginine residue at position 477 is replaced by a lysine residue (R477K). In some embodiments, the arginine residue at position 477 is replaced by a threonine residue (R477T). In some embodiments, the arginine residue at position 477 is replaced by a phenylalanine residue (R477F). In some embodiments, the arginine residue at position 474 is replaced by a glutamic acid residue (R477E).

In some embodiments, the adenosine deaminase comprises a mutation at glycine478 of the hADAR2-D amino acid sequence, or a corresponding position in a homologous ADAR protein. In some embodiments, the glycine residue at position 478 is replaced by an alanine residue (G478A). In some embodiments, the glycine residue at position 478 is replaced by an arginine residue (G478R). In some embodiments, the glycine residue at position 478 is replaced by a tyrosine residue (G478Y).

In some embodiments, the adenosine deaminase comprises a mutation at glutamine479 of the hADAR2-D amino acid sequence, or a corresponding position in a homologous ADAR protein. In some embodiments, the glutamine residue at position 479 is replaced by an asparagine residue (Q479N). In some embodiments, the glutamine residue at position 479 is replaced by a serine residue (Q479S). In some embodiments, the glutamine residue at position 479 is replaced by a proline residue (Q479P).

In some embodiments, the adenosine deaminase comprises a mutation at arginine348 of the hADAR2-D amino acid sequence, or a corresponding position in a homologous ADAR protein. In some embodiments, the arginine residue at position 348 is replaced by an alanine residue (R348A). In some embodiments, the arginine residue at position 348 is replaced by a glutamic acid residue (R348E).

In some embodiments, the adenosine deaminase comprises a mutation at valine351 of the hADAR2-D amino acid sequence, or a corresponding position in a homologous ADAR protein. In some embodiments, the valine residue at position 351 is replaced by a leucine residue (V351L).

In some embodiments, the adenosine deaminase comprises a mutation at threonine375 of the hADAR2-D amino acid sequence, or a corresponding position in a homologous ADAR protein. In some embodiments, the threonine residue at position 375 is replaced by a glycine residue (T375G). In some embodiments, the threonine residue at position 375 is replaced by a serine residue (T375S).

In some embodiments, the adenosine deaminase comprises a mutation at arginine481 of the hADAR2-D amino acid sequence, or a corresponding position in a homologous ADAR protein. In some embodiments, the arginine residue at position 481 is replaced by a glutamic acid residue (R481E).

In some embodiments, the adenosine deaminase comprises a mutation at serine486 of the hADAR2-D amino acid sequence, or a corresponding position in a homologous ADAR protein. In some embodiments, the serine residue at position 486 is replaced by a threonine residue (S486T).

In some embodiments, the adenosine deaminase comprises a mutation at threonine490 of the hADAR2-D amino acid sequence, or a corresponding position in a homologous ADAR protein. In some embodiments, the threonine residue at position 490 is replaced by an alanine residue (T490A). In some embodiments, the threonine residue at position 490 is replaced by a serine residue (T490S).

In some embodiments, the adenosine deaminase comprises a mutation at serine495 of the hADAR2-D amino acid sequence, or a corresponding position in a homologous ADAR protein. In some embodiments, the serine residue at position 495 is replaced by a threonine residue (S495T).

In some embodiments, the adenosine deaminase comprises a mutation at arginine510 of the hADAR2-D amino acid sequence, or a corresponding position in a homologous ADAR protein. In some embodiments, the arginine residue at position 510 is replaced by a glutamine residue (R510Q). In some embodiments, the arginine residue at position 510 is replaced by an alanine residue (R510A). In some embodiments, the arginine residue at position 510 is replaced by a glutamic acid residue (R510E).

In some embodiments, the adenosine deaminase comprises a mutation at glycine593 of the hADAR2-D amino acid sequence, or a corresponding position in a homologous ADAR protein. In some embodiments, the glycine residue at position 593 is replaced by an alanine residue (G593A). In some embodiments, the glycine residue at position 593 is replaced by a glutamic acid residue (G593E).

In some embodiments, the adenosine deaminase comprises a mutation at lysine594 of the hADAR2-D amino acid sequence, or a corresponding position in a homologous ADAR protein. In some embodiments, the lysine residue at position 594 is replaced by an alanine residue (K594A).

In some embodiments, the adenosine deaminase comprises a mutation at any one or more of positions A454, R455, I456, F457, S458, P459, H460, P462, D469, R470, H471, P472, N473, R474, K475, A476, R477, G478, Q479, R348, R510, G593, K594 of the hADAR2-D amino acid sequence, or a corresponding position in a homologous ADAR protein.

In some embodiments, the adenosine deaminase comprises any one or more of mutations A454S, A454C, A454D, R455A, R455V, R455H, I456V, I456L, I456D, F457Y, F457R, F457E, S458V, S458F, S458P, P459C, P459H, P459W, H460R, H460I, H460P, P462S, P462W, P462E, D469Q, D469S, D469Y, R470A, R470I, R470D, H471K, H471T, H471V, P472K, P472T, P472D, N473R, N473W, N473P, R474K, R474G, R474D, K475Q, K475N, K475D, A476S, A476R, A476E, R477K, R477T, R477F, G478A, G478R, G478Y, Q479N, Q479S, Q479P, R348A, R510Q, R510A, G593A, G593E, K594A of the hADAR2-D amino acid sequence, or a corresponding position in a homologous ADAR protein.

In certain embodiments the adenosine deaminase is mutated to convert the activity to cytidine deaminase. Accordingly in some embodiments, the adenosine deaminase comprises one or more mutations in positions selected from E396, C451, V351, R455, T375, K376? S486, Q488, R510, K594, R348, G593, S397, H443, L444, Y445, F442, E438, T448, A353, V355, T339, P539, T339, P539, V525 1520, P462 and N579. In particular embodiments, the adenosine deaminase comprises one or more mutations in a position selected from V351, L444, V355, V525 and I520. In some embodiments, the adenosine deaminase may comprises one or more of mutations at E488, V351, S486, T375, S370, P462, N597, based on amino acid sequence positions of hADAR2-D, and mutations in a homologous ADAR protein corresponding to the above. In some embodiments, the adenosine deaminase may comprise one or more of the mutations: E488Q, V351G, S486A, T375S, S370C, P462A, N597I, based on amino acid sequence positions of hADAR2-D, and mutations in a homologous ADAR protein corresponding These modifications are of interest for use in methods for modifying a Cytosine in a target RNA of interest, comprising, delivering to said target RNA (a) a catalytically inactive (dead) Cas13 protein; (b) a guide molecule which comprises a guide sequence linked to a direct repeat sequence; and (c) an cytosine deaminase protein or catalytic domain thereof which is an adenosine deaminase modified as described herein above to ensure cytosine deaminase activity, wherein said cytosine deaminase protein or catalytic domain thereof is covalently or non-covalently linked to said dead Cas13 protein or said guide molecule or is adapted to link thereto after delivery; wherein guide molecule forms a complex with said dead Cas13 protein and directs said complex to bind said target RNA sequence of interest, wherein said guide sequence is capable of hybridizing with a target sequence comprising said Cytosine to form an RNA duplex, wherein said guide sequence comprises a non-pairing Adenine or Uracil at a position corresponding to said Cytosine resulting in an C-A/U mismatch in the RNA duplex formed; wherein said cytosine deaminase protein or catalytic domain thereof deaminates said cytosine in said RNA duplex. These methods are of interest in the treatment or prevention of diseases caused by a T→C or A→G point mutation or pathogenic SNP.

to the above.

In certain embodiments, improvement of editing and reduction of off-target modification is achieved by chemical modification of gRNAs. gRNAs which are chemically modified as exemplified in Vogel et al. (2014), Angew Chem Int Ed, 53:6267-6271, doi:10.1002/anie.201402634 (incorporated herein by reference in its entirety) reduce off-target activity and improve on-target efficiency. 2'-O-methyl and phosphorothioate modified guide RNAs in general improve editing efficiency in cells.

ADAR has been known to demonstrate a preference for neighboring nucleotides on either side of the edited A (www.nature.com/nsmb/journal/v23/n5/full/nsmb.3203.html, Matthews et al. (2017), Nature Structural Mol Biol, 23(5): 426-433, incorporated herein by reference in its entirety). Accordingly, in certain embodiments, the gRNA, target, and/or ADAR is selected optimized for motif preference.

Intentional mismatches have been demonstrated in vitro to allow for editing of non-preferred motifs (academic.oup-.com/nar/article-lookup/doi/10.1093/nar/gku272; Schneider et al (2014), Nucleic Acid Res, 42(10):e87); Fukuda et al. (2017), Scientific Reports, 7, doi:10.1038/srep41478, incorporated herein by reference in its entirety). Accordingly, in certain embodiments, to enhance RNA editing efficiency on non-preferred 5' or 3' neighboring bases, intentional mismatches in neighboring bases are introduced.

Results suggest that As opposite Cs in the targeting window of the ADAR deaminase domain are preferentially edited over other bases. Additionally, As base-paired with Us within a few bases of the targeted base show low levels of editing by Cas13b-ADAR fusions, suggesting that there is flexibility for the enzyme to edit multiple A's. See e.g. FIG. 18. These two observations suggest that multiple As in the activity window of Cas13b-ADAR fusions could be specified for editing by mismatching all As to be edited with Cs. Accordingly, in certain embodiments, multiple A:C mismatches in the activity window are designed to create multiple A:I edits. In certain embodiments, to suppress potential off-target editing in the activity window, non-target As are paired with As or Gs.

The terms "editing specificity" and "editing preference" are used interchangeably herein to refer to the extent of A-to-I editing at a particular adenosine site in a double-stranded substrate. In some embodiment, the substrate editing preference is determined by the 5' nearest neighbor and/or the 3' nearest neighbor of the target adenosine residue. In some embodiments, the adenosine deaminase has preference for the 5' nearest neighbor of the substrate ranked as U>A>C>G (">" indicates greater preference). In some embodiments, the adenosine deaminase has preference for the 3' nearest neighbor of the substrate ranked as G>C~A>U (">" indicates greater preference; "~" indicates similar preference). In some embodiments, the adenosine deaminase has preference for the 3' nearest neighbor of the substrate ranked as G>C>U~A (">" indicates greater preference; "~" indicates similar preference). In some embodiments, the adenosine deaminase has preference for the 3' nearest neighbor of the substrate ranked as G>C>A>U (">" indicates greater preference). In some embodiments, the adenosine deaminase has preference for the 3' nearest neighbor of the substrate ranked as C~G~A>U (">" indicates greater preference; "~" indicates similar preference). In some embodiments, the adenosine deaminase has preference for a triplet sequence containing the target adenosine residue ranked as TAG>AAG>CAC>AAT>GAA>GAC (">" indicates greater preference), the center A being the target adenosine residue.

In some embodiments, the substrate editing preference of an adenosine deaminase is affected by the presence or absence of a nucleic acid binding domain in the adenosine deaminase protein. In some embodiments, to modify substrate editing preference, the deaminase domain is connected with a double-strand RNA binding domain (dsRBD) or a double-strand RNA binding motif (dsRBM). In some embodiments, the dsRBD or dsRBM may be derived from an ADAR protein, such as hADAR1 or hADAR2. In some embodiments, a full length ADAR protein that comprises at least one dsRBD and a deaminase domain is used. In some embodiments, the one or more dsRBM or dsRBD is at the N-terminus of the deaminase domain. In other embodiments, the one or more dsRBM or dsRBD is at the C-terminus of the deaminase domain.

In some embodiments, the substrate editing preference of an adenosine deaminase is affected by amino acid residues near or in the active center of the enzyme. In some embodiments, to modify substrate editing preference, the adenosine deaminase may comprise one or more of the mutations:

G336D, G487R, G487K, G487W, G487Y, E488Q, E488N, T490A, V493A, V493T, V493S, N597K, N597R, A589V, S599T, N613K, N613R, based on amino acid sequence positions of hADAR2-D, and mutations in a homologous ADAR protein corresponding to the above.

Particularly, in some embodiments, to reduce editing specificity, the adenosine deaminase can comprise one or more of mutations E488Q, V493A, N597K, N613K, based on amino acid sequence positions of hADAR2-D, and mutations in a homologous ADAR protein corresponding to the above. In some embodiments, to increase editing specificity, the adenosine deaminase can comprise mutation T490A.

In some embodiments, to increase editing preference for target adenosine (A) with an immediate 5' G, such as substrates comprising the triplet sequence GAC, the center A being the target adenosine residue, the adenosine deaminase can comprise one or more of mutations G336D, E488Q, E488N, V493T, V493S, V493A, A589V, N597K, N597R, S599T, N613K, N613R, based on amino acid sequence positions of hADAR2-D, and mutations in a homologous ADAR protein corresponding to the above.

Particularly, in some embodiments, the adenosine deaminase comprises mutation E488Q or a corresponding mutation in a homologous ADAR protein for editing substrates comprising the following triplet sequences: GAC, GAA, GAU, GAG, CAU, AAU, UAC, the center A being the target adenosine residue.

In some embodiments, the adenosine deaminase comprises the wild-type amino acid sequence of hADAR1-D as defined in SEQ ID No. 761. In some embodiments, the adenosine deaminase comprises one or more mutations in the hADAR1-D sequence, such that the editing efficiency, and/or substrate editing preference of hADAR1-D is changed according to specific needs.

In some embodiments, the adenosine deaminase comprises a mutation at Glycine1007 of the hADAR1-D amino acid sequence, or a corresponding position in a homologous ADAR protein. In some embodiments, the glycine residue at position 1007 is replaced by a non-polar amino acid residue with relatively small side chains. For example, in some embodiments, the glycine residue at position 1007 is replaced by an alanine residue (G1007A). In some embodiments, the glycine residue at position 1007 is replaced by a valine residue (G1007V). In some embodiments, the glycine residue at position 1007 is replaced by an amino acid residue with relatively large side chains. In some embodiments, the glycine residue at position 1007 is replaced by an arginine residue (G1007R). In some embodiments, the glycine residue at position 1007 is replaced by a lysine residue (G1007K). In some embodiments, the glycine residue at position 1007 is replaced by a tryptophan residue (G1007W). In some embodiments, the glycine residue at position 1007 is replaced by a tyrosine residue (G1007Y). Additionally, in other embodiments, the glycine residue at position 1007 is replaced by a leucine residue (G1007L). In other embodiments, the glycine residue at position 1007 is replaced by a threonine residue (G1007T). In other embodiments, the glycine residue at position 1007 is replaced by a serine residue (G1007S).

In some embodiments, the adenosine deaminase comprises a mutation at glutamic acid1008 of the hADAR1-D amino acid sequence, or a corresponding position in a homologous ADAR protein. In some embodiments, the glutamic acid residue at position 1008 is replaced by a polar amino acid residue having a relatively large side chain. In some embodiments, the glutamic acid residue at position 1008 is replaced by a glutamine residue (E1008Q). In some embodiments, the glutamic acid residue at position 1008 is replaced by a histidine residue (E1008H). In some embodiments, the glutamic acid residue at position 1008 is replaced by an arginine residue (E1008R). In some embodiments, the glutamic acid residue at position 1008 is replaced by a lysine residue (E1008K). In some embodiments, the glutamic acid residue at position 1008 is replaced by a nonpolar or small polar amino acid residue. In some embodiments, the glutamic acid residue at position 1008 is replaced by a phenylalanine residue (E1008F). In some embodiments, the glutamic acid residue at position 1008 is replaced by a tryptophan residue (E1008W). In some embodiments, the glutamic acid residue at position 1008 is replaced by a glycine residue (E1008G). In some embodiments, the glutamic acid residue at position 1008 is replaced by an isoleucine residue (E1008I). In some embodiments, the glutamic acid residue at position 1008 is replaced by a valine residue (E1008V). In some embodiments, the glutamic acid residue at position 1008 is replaced by a proline residue (E1008P). In some embodiments, the glutamic acid residue at position 1008 is replaced by a serine residue (E1008S). In other embodiments, the glutamic acid residue at position 1008 is replaced by an asparagine residue (E1008N). In other embodiments, the glutamic acid residue at position 1008 is replaced by an alanine residue (E1008A). In other embodiments, the glutamic acid residue at position 1008 is replaced by a Methionine residue (E1008M). In some embodiments, the glutamic acid residue at position 1008 is replaced by a leucine residue (E1008L).

In some embodiments, to improve editing efficiency, the adenosine deaminase may comprise one or more of the mutations: E1007S, E1007A, E1007V, E1008Q, E1008R, E1008H, E1008M, E1008N, E1008K, based on amino acid sequence positions of hADAR1-D, and mutations in a homologous ADAR protein corresponding to the above.

In some embodiments, to reduce editing efficiency, the adenosine deaminase may comprise one or more of the mutations: E1007R, E1007K, E1007Y, E1007L, E1007T, E1008G, E1008I, E1008P, E1008V, E1008F, E1008W, E1008S, E1008N, E1008K, based on amino acid sequence positions of hADAR1-D, and mutations in a homologous ADAR protein corresponding to the above.

In some embodiments, the substrate editing preference, efficiency and/or selectivity of an adenosine deaminase is affected by amino acid residues near or in the active center of the enzyme. In some embodiments, the adenosine deaminase comprises a mutation at the glutamic acid 1008 position in hADAR1-D sequence, or a corresponding position in a homologous ADAR protein. In some embodiments, the mutation is E1008R, or a corresponding mutation in a homologous ADAR protein. In some embodiments, the E1008R mutant has an increased editing efficiency for target adenosine residue that has a mismatched G residue on the opposite strand.

In some embodiments, the adenosine deaminase protein further comprises or is connected to one or more double-stranded RNA (dsRNA) binding motifs (dsRBMs) or domains (dsRBDs) for recognizing and binding to double-stranded nucleic acid substrates. In some embodiments, the interaction between the adenosine deaminase and the double-stranded substrate is mediated by one or more additional protein factor(s), including a CRISPR/CAS protein factor. In some embodiments, the interaction between the adenosine deaminase and the double-stranded substrate is further mediated by one or more nucleic acid component(s), including a guide RNA.

In certain example embodiments, directed evolution may be used to design modified ADAR proteins capable of catalyzing additional reactions besides deamination of a adenine to a hypoxanthine. For example According to the present invention, the substrate of the adenosine deaminase is an RNA/DNAn RNA duplex formed upon binding of the guide molecule to its DNA target which then forms the CRISPR-Cas complex with the CRISPR-Cas enzyme. The RNA/DNA or DNA/RNAn RNA duplex is also referred to herein as the "RNA/DNA hybrid", "DNA/RNA hybrid" or "double-stranded substrate". The particular features of the guide molecule and CRISPR-Cas enzyme are detailed below.

The term "editing selectivity" as used herein refers to the fraction of all sites on a double-stranded substrate that is edited by an adenosine deaminase. Without being bound by theory, it is contemplated that editing selectivity of an adenosine deaminase is affected by the double-stranded substrate's length and secondary structures, such as the presence of mismatched bases, bulges and/or internal loops.

In some embodiments, when the substrate is a perfectly base-paired duplex longer than 50 bp, the adenosine deaminase may be able to deaminate multiple adenosine residues within the duplex (e.g., 50% of all adenosine residues). In some embodiments, when the substrate is shorter than 50 bp, the editing selectivity of an adenosine deaminase is affected by the presence of a mismatch at the target adenosine site. Particularly, in some embodiments, adenosine (A) residue having a mismatched cytidine (C) residue on the opposite strand is deaminated with high efficiency. In some embodiments, adenosine (A) residue having a mismatched guanosine (G) residue on the opposite strand is skipped without editing.

CRISPR-Cas Protein and Guide

In the methods and systems of the present invention use is made of a CRISPR-Cas protein and corresponding guide molecule. More particularly, the CRISPR-Cas protein is a class 2 CRISPR-Cas protein. In certain embodiments, said CRISPR-Cas protein is a Cas13. The CRISPR-Cas system does not require the generation of customized proteins to target specific sequences but rather a single Cas protein can be programmed by guide molecule to recognize a specific nucleic acid target, in other words the Cas enzyme protein can be recruited to a specific nucleic acid target locus of interest using said guide molecule.

Guide Molecule

The guide molecule or guide RNA of a Class 2 type V CRISPR-Cas protein comprises a tracr-mate sequence (encompassing a "direct repeat" in the context of an endogenous CRISPR system) and a guide sequence (also referred to as a "spacer" in the context of an endogenous CRISPR system). Indeed, in contrast to the type II CRISPR-Cas proteins, the Cas13 protein does not rely on the presence of a tracr sequence. In some embodiments, the CRISPR-Cas system or complex as described herein does not comprise and/or does not rely on the presence of a tracr sequence (e.g. if the Cas protein is Cas13). In certain embodiments, the guide molecule may comprise, consist essentially of, or consist of a direct repeat sequence fused or linked to a guide sequence or spacer sequence.

In general, a CRISPR system is characterized by elements that promote the formation of a CRISPR complex at the site of a target sequence. In the context of formation of a CRISPR complex, "target sequence" refers to a sequence to which a guide sequence is designed to have complementarity, where hybridization between a target DNA sequence and a guide sequence promotes the formation of a CRISPR complex.

The terms "guide molecule" and "guide RNA" are used interchangeably herein to refer to RNA-based molecules that are capable of forming a complex with a CRISPR-Cas protein and comprises a guide sequence having sufficient complementarity with a target nucleic acid sequence to hybridize with the target nucleic acid sequence and direct sequence-specific binding of the complex to the target nucleic acid sequence. The guide molecule or guide RNA specifically encompasses RNA-based molecules having one or more chemically modifications (e.g., by chemical linking two ribonucleotides or by replacement of one or more ribonucleotides with one or more deoxyribonucleotides), as described herein.

As used herein, the term "guide sequence" in the context of a CRISPR-Cas system, comprises any polynucleotide sequence having sufficient complementarity with a target nucleic acid sequence to hybridize with the target nucleic acid sequence and direct sequence-specific binding of a nucleic acid-targeting complex to the target nucleic acid sequence. In the context of the present invention the target nucleic acid sequence or target sequence is the sequence comprising the target adenosine to be deaminated also referred to herein as the "target adenosine". In some embodiments, except for the intended dA-C mismatch, the degree of complementarity, when optimally aligned using a suitable alignment algorithm, is about or more than about 50%, 60%, 75%, 80%, 85%, 90%, 95%, 97.5%, 99%, or more. Optimal alignment may be determined with the use of any suitable algorithm for aligning sequences, non-limiting example of which include the Smith-Waterman algorithm, the Needleman-Wunsch algorithm, algorithms based on the Burrows-Wheeler Transform (e.g., the Burrows Wheeler Aligner), ClustalW, Clustal X, BLAT, Novoalign (Novocraft Technologies; available at www.novocraft.com), ELAND (Illumina, San Diego, CA), SOAP (available at soap.genomics.org.cn), and Maq (available at maq.sourceforge.net). The ability of a guide sequence (within a nucleic acid-targeting guide RNA) to direct sequence-specific binding of a nucleic acid-targeting complex to a target nucleic acid sequence may be assessed by any suitable assay. For example, the components of a nucleic acid-targeting CRISPR system sufficient to form a nucleic acid-targeting complex, including the guide sequence to be tested, may be provided to a host cell having the corresponding target nucleic acid sequence, such as by transfection with vectors encoding the components of the nucleic acid-targeting complex, followed by an assessment of preferential targeting (e.g., cleavage) within the target nucleic acid sequence, such as by Surveyor assay as described herein. Similarly, cleavage of a target nucleic acid sequence (or a sequence in the vicinity thereof) may be evaluated in a test tube by providing the target nucleic acid sequence, components of a nucleic acid-targeting complex, including the guide sequence to be tested and a control guide sequence different from the test guide sequence, and comparing binding or rate of cleavage at or in the vicinity of the target sequence between the test and control guide sequence reactions. Other assays are possible, and will occur to those skilled in the art. A guide sequence, and hence a nucleic acid-targeting guide RNA may be selected to target any target nucleic acid sequence.

In some embodiments, the guide molecule comprises a guide sequence that is designed to have at least one mismatch with the target sequence, such that an RNA duplex formed between the guide sequence and the target sequence comprises a non-pairing C in the guide sequence opposite to the target A for deamination on the target sequence. In some embodiments, aside from this A-C mismatch, the degree of complementarity, when optimally aligned using a suitable alignment algorithm, is about or more than about 50%, 60%, 75%, 80%, 85%, 90%, 95%, 97.5%, 99%, or more.

In certain embodiments, the guide sequence or spacer length of the guide molecules is from 15 to 50 nt. In certain embodiments, the spacer length of the guide RNA is at least 15 nucleotides. In certain embodiments, the spacer length is from 15 to 17 nt, e.g., 15, 16, or 17 nt, from 17 to 20 nt, e.g., 17, 18, 19, or 20 nt, from 20 to 24 nt, e.g., 20, 21, 22, 23, or 24 nt, from 23 to 25 nt, e.g., 23, 24, or 25 nt, from 24 to 27 nt, e.g., 24, 25, 26, or 27 nt, from 27-30 nt, e.g., 27, 28, 29, or 30 nt, from 30-35 nt, e.g., 30, 31, 32, 33, 34, or 35 nt, or 35 nt or longer. In certain example embodiment, the guide sequence is 15, 16, 17, 18, 19, 20, 21, 22, 23, 24, 25, 26, 27, 28, 29, 30, 31, 32, 33, 34, 35, 36, 37, 38, 39 40, 41, 42, 43, 44, 45, 46, 47 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, or 100 nt.

In some embodiments, the guide sequence is an RNA sequence of between 10 to 50 nt in length, but more particularly of about 20-30 nt advantageously about 20 nt, 23-25 nt or 24 nt. The guide sequence is selected so as to ensure that it hybridizes to the target sequence comprising the adenosine to be deaminated. This is described more in detail below. Selection can encompass further steps which increase efficacy and specificity of deamination.

In some embodiments, the guide sequence is about 20 nt to about 30 nt long and hybridizes to the target DNA strand to form an almost perfectly matched duplex, except for having a dA-C mismatch at the target adenosine site. Particularly, in some embodiments, the dA-C mismatch is located close to the center of the target sequence (and thus the center of the duplex upon hybridization of the guide sequence to the target sequence), thereby restricting the adenosine deaminase to a narrow editing window (e.g., about 4 bp wide). In some embodiments, the target sequence may comprise more than one target adenosine to be deaminated. In further embodiments the target sequence may further comprise one or more dA-C mismatch 3' to the target adenosine site. In some embodiments, to avoid off-target editing at an unintended Adenine site in the target sequence, the guide sequence can be designed to comprise a non-pairing Guanine at a position corresponding to said unintended Adenine to introduce a dA-G mismatch, which is catalytically unfavorable for certain adenosine deaminases such as ADAR1 and ADAR2. See Wong et al., RNA 7:846-858 (2001), which is incorporated herein by reference in its entirety.

In some embodiments, a Cas13 guide sequence having a canonical length (e.g., about 24 nt for AsCas13) is used to form an RNA duplex with the target DNA. In some embodiments, a Cas13 guide molecule longer than the canonical length (e.g., >24 nt for AsCas13) is used to form an RNA duplex with the target DNA including outside of the Cas13-guide RNA-target DNA complex. This can be of interest where deamination of more than one adenine within a given stretch of nucleotides is of interest. In alternative embodiments, it is of interest to maintain the limitation of the canonical guide sequence length. In some embodiments, the guide sequence is designed to introduce a dA-C mismatch outside of the canonical length of Cas13 guide, which may decrease steric hindrance by Cas13 and increase the frequency of contact between the adenosine deaminase and the dA-C mismatch.

In some embodiments, the sequence of the guide molecule (direct repeat and/or spacer) is selected to reduce the degree secondary structure within the guide molecule. In some embodiments, about or less than about 75%, 50%, 40%, 30%, 25%, 20%, 15%, 10%, 5%, 1%, or fewer of the nucleotides of the nucleic acid-targeting guide RNA participate in self-complementary base pairing when optimally folded. Optimal folding may be determined by any suitable polynucleotide folding algorithm. Some programs are based on calculating the minimal Gibbs free energy. An example of one such algorithm is mFold, as described by Zuker and Stiegler (Nucleic Acids Res. 9 (1981), 133-148). Another example folding algorithm is the online webserver RNAfold, developed at Institute for Theoretical Chemistry at the University of Vienna, using the centroid structure prediction algorithm (see e.g., A. R. Gruber et al., 2008, Cell 106(1): 23-24; and P A Carr and G M Church, 2009, Nature Biotechnology 27(12): 1151-62).

In some embodiments, it is of interest to reduce the susceptibility of the guide molecule to RNA cleavage, such as to cleavage by Cas13. Accordingly, in particular embodiments, the guide molecule is adjusted to avoid cleavage by Cas13 or other RNA-cleaving enzymes.

In certain embodiments, the guide molecule comprises non-naturally occurring nucleic acids and/or non-naturally occurring nucleotides and/or nucleotide analogs, and/or chemically modifications. Preferably, these non-naturally occurring nucleic acids and non-naturally occurring nucleotides are located outside the guide sequence. Non-naturally occurring nucleic acids can include, for example, mixtures of naturally and non-naturally occurring nucleotides. Non-naturally occurring nucleotides and/or nucleotide analogs may be modified at the ribose, phosphate, and/or base moiety. In an embodiment of the invention, a guide nucleic acid comprises ribonucleotides and non-ribonucleotides. In one such embodiment, a guide comprises one or more ribonucleotides and one or more deoxyribonucleotides. In an embodiment of the invention, the guide comprises one or more non-naturally occurring nucleotide or nucleotide analog such as a nucleotide with phosphorothioate linkage, a locked nucleic acid (LNA) nucleotides comprising a methylene bridge between the 2' and 4' carbons of the ribose ring, or bridged nucleic acids (BNA). Other examples of modified nucleotides include 2'-O-methyl analogs, 2'-deoxy analogs, or 2'-fluoro analogs. Further examples of modified bases include, but are not limited to, 2-aminopurine, 5-bromo-uridine, pseudouridine, inosine, 7-methylguanosine. Examples of guide RNA chemical modifications include, without limitation, incorporation of 2'-O-methyl (M), 2'-O-methyl 3'phosphorothioate (MS), S-constrained ethyl(cEt), or 2'-O-methyl 3'thioPACE (MSP) at one or more terminal nucleotides. Such chemically modified guides can comprise increased stability and increased activity as compared to unmodified guides, though on-target vs. off-target specificity is not predictable. (See, Hendel, 2015, Nat Biotechnol. 33(9):985-9, doi: 10.1038/nbt.3290, published online 29 Jun. 2015 Ragdarm et al., 0215, PNAS, E7110-E7111; Allerson et al., J. Med. Chem. 2005, 48:901-904; Bramsen et al., Front. Genet., 2012, 3:154; Deng et al., PNAS, 2015, 112:11870-11875; Sharma et al., MedChemComm., 2014, 5:1454-1471; Hendel et al., Nat. Biotechnol. (2015) 33(9): 985-989; Li et al., Nature Biomedical Engineering, 2017, 1, 0066 DOI:10.1038/s41551-017-0066). In some embodiments, the 5' and/or 3' end of a guide RNA is modified by a variety of functional moieties including fluorescent dyes, polyethylene glycol, cholesterol, proteins, or detection tags. (See Kelly et al., 2016, J. Biotech. 233:74-83). In certain embodiments, a guide comprises ribonucleotides in a region that binds to a target DNA and one or more deoxyribonucleotides and/or nucleotide analogs in a region that binds to Cas13. In an embodiment of the invention, deoxyribonucleotides and/or nucleotide analogs are incorporated in engineered guide structures, such as, without limitation, stem-loop regions, and the seed region. For Cas13 guide, in certain embodiments, the modification is not in the 5'-handle of the stem-loop regions. Chemical modification in the 5'-handle of the stem-loop region of a guide may abolish its function (see Li, et al., Nature Biomedical Engineering, 2017, 1:0066). In certain embodiments, at least 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 35, 40, 45, 50, or 75 nucleotides of a guide is chemically modified. In some embodiments, 3-5 nucleotides at either the 3' or the 5' end of a guide is chemically modified. In some embodiments, only minor modifications are introduced in the seed region, such as 2'-F modifications. In some embodiments, 2'-F modification is introduced at the 3' end of a guide. In certain embodiments, three to five nucleotides at the 5' and/or the 3' end of the guide are chemically modified with 2'-O-methyl (M), 2'-O-methyl 3' phosphorothioate (MS), S-constrained ethyl(cEt), or 2'-O-methyl 3' thioPACE (MSP). Such modification can enhance genome editing efficiency (see Hendel et al., Nat. Biotechnol. (2015) 33(9): 985-989). In certain embodiments, all of the phosphodiester bonds of a guide are substituted with phosphorothioates (PS) for enhancing levels of gene disruption. In certain embodiments, more than five nucleotides at the 5' and/or the 3' end of the guide are chemically modified with 2'-O-Me, 2'-F or S-constrained ethyl(cEt). Such chemically modified guide can mediate enhanced levels of gene disruption (see Ragdarm et al., 0215, PNAS, E7110-E7111). In an embodiment of the invention, a guide is modified to comprise a chemical moiety at its 3' and/or 5' end. Such moieties include, but are not limited to amine, azide, alkyne, thio, dibenzocyclooctyne (DBCO), or Rhodamine. In certain embodiment, the chemical moiety is conjugated to the guide by a linker, such as an alkyl chain. In certain embodiments, the chemical moiety of the modified guide can be used to attach the guide to another molecule, such as DNA, RNA, protein, or nanoparticles. Such chemically modified guide can be used to identify or enrich cells generically edited by a CRISPR system (see Lee et al., eLife, 2017, 6:e25312, DOI:10.7554).

In some embodiments, the guide comprises a modified Cas13 crRNA, having a 5'-handle and a guide segment further comprising a seed region and a 3'-terminus. In some embodiments, the modified guide can be used with a Cas13 of any one of *Acidaminococcus* sp. BV3L6 Cas13 (AsCas13); *Francisella tularensis* subsp. *Novicida* U112 Cas13 (FnCas13); L. bacterium MC2017 Cas13 (Lb3Cas13); *Butyrivibrio proteoclasticus* Cas13 (BpCas13); Parcubacteria bacterium GWC2011_GWC2_44_17 Cas13 (PbCas13); Peregrinibacteria bacterium GW2011_GWA_33_10 Cas13 (PeCas13); *Leptospira inadai* Cas13 (LiCas13); *Smithella* sp. SC_K08D17 Cas13 (SsCas13); L. bacterium MA2020 Cas13 (Lb2Cas13); *Porphyromonas crevioricanis* Cas13 (PcCas13); *Porphyromonas macacae* Cas13 (PmCas13); *Candidatus Methanoplasma termitum* Cas13 (CMtCas13); *Eubacterium eligens* Cas13 (EeCas13); *Moraxella bovoculi* 237 Cas13 (MbCas13); *Prevotella disiens* Cas13 (PdCas13); or L. bacterium ND2006 Cas13 (LbCas13).

In some embodiments, the modification to the guide is a chemical modification, an insertion, a deletion or a split. In some embodiments, the chemical modification includes, but is not limited to, incorporation of 2'-O-methyl (M) analogs, 2'-deoxy analogs, 2-thiouridine analogs, N6-methyladenosine analogs, 2'-fluoro analogs, 2-aminopurine, 5-bromo-uridine, pseudouridine (Ψ), N1-methylpseudouridine (me1Ψ), 5-methoxyuridine(5moU), inosine, 7-methylguanosine, 2'-O-methyl 3'phosphorothioate (MS), S-constrained ethyl(cEt), phosphorothioate (PS), or 2'-O-methyl 3'thioPACE (MSP). In some embodiments, the guide comprises one or more of phosphorothioate modifications. In certain embodiments, at least 1, 2, 3, 4, 5, 6, 7, 8, 9, 10, 11, 12, 13, 14, 15, 16, 17, 18, 19, 20, or 25 nucleotides of the guide are chemically modified. In certain embodiments, one or more nucleotides in the seed region are chemically modified. In certain embodiments, one or more nucleotides in the 3'-terminus are chemically modified. In certain embodiments, none of the nucleotides in the 5'-handle is chemically modified. In some embodiments, the chemical modification in the seed region is a minor modification, such as incorporation of a 2'-fluoro analog. In a specific embodiment, one nucleotide of the seed region is replaced with a 2'-fluoro analog. In some embodiments, 5 to 10 nucleotides in the 3'-terminus are chemically modified. Such chemical modifications at the 3'-terminus of the Cas13 CrRNA may improve Cas13 activity (see Li, et al., Nature Biomedical Engineering, 2017, 1:0066). In a specific embodiment, 1, 2, 3, 4, 5, 6, 7, 8, 9 or 10 nucleotides in the 3'-terminus are replaced with 2'-fluoro analogues. In a specific embodiment, 1, 2, 3, 4, 5, 6, 7, 8, 9 or 10 nucleotides in the 3'-terminus are replaced with 2'-O-methyl (M) analogs.

In some embodiments, the loop of the 5'-handle of the guide is modified. In some embodiments, the loop of the 5'-handle of the guide is modified to have a deletion, an insertion, a split, or chemical modifications. In certain embodiments, the modified loop comprises 3, 4, or 5 nucleotides. In certain embodiments, the loop comprises the sequence of UCUU, UUUU, UAUU, or UGUU.

In some embodiments, the guide molecule forms a stem loop with a separate non-covalently linked sequence, which can be DNA or RNA. In particular embodiments, the sequences forming the guide are first synthesized using the standard phosphoramidite synthetic protocol (Herdewijn, P., ed., Methods in Molecular Biology Col 288, Oligonucleotide Synthesis: Methods and Applications, Humana Press, New Jersey (2012)). In some embodiments, these sequences can be functionalized to contain an appropriate functional group for ligation using the standard protocol known in the art (Hermanson, G. T., Bioconjugate Techniques, Academic Press (2013)). Examples of functional groups include, but are not limited to, hydroxyl, amine, carboxylic acid, carboxylic acid halide, carboxylic acid active ester, aldehyde, carbonyl, chlorocarbonyl, imidazolylcarbonyl, hydrozide, semicarbazide, thio semicarbazide, thiol, maleimide, haloalkyl, sulfonyl, ally, propargyl, diene, alkyne, and azide. Once this sequence is functionalized, a covalent chemical bond or linkage can be formed between this sequence and the direct repeat sequence. Examples of chemical bonds include, but are not limited to, those based on carbamates, ethers, esters, amides, imines, amidines, aminotrizines, hydrozone, disulfides, thioethers, thioesters, phosphorothioates, phosphorodithioates, sulfonamides, sulfonates, fulfones, sulfoxides, ureas, thioureas, hydrazide, oxime, triazole, photolabile linkages, C—C bond forming groups such as Diels-Alder cyclo-addition pairs or ring-closing metathesis pairs, and Michael reaction pairs.

In some embodiments, these stem-loop forming sequences can be chemically synthesized. In some embodiments, the chemical synthesis uses automated, solid-phase oligonucleotide synthesis machines with 2'-acetoxyethyl orthoester (2'-ACE) (Scaringe et al., J. Am. Chem. Soc. (1998) 120: 11820-11821; Scaringe, Methods Enzymol. (2000) 317: 3-18) or 2'-thionocarbamate (2'-TC) chemistry (Dellinger et al., J. Am. Chem. Soc. (2011) 133: 11540-11546; Hendel et al., Nat. Biotechnol. (2015) 33:985-989).

In certain embodiments, the guide molecule (capable of guiding Cas13 to a target locus) comprises (1) a guide sequence capable of hybridizing to a target locus and (2) a tracr mate or direct repeat sequence whereby the direct repeat sequence is located upstream (i.e., 5') from the guide sequence. In a particular embodiment the seed sequence (i.e. the sequence essential critical for recognition and/or hybridization to the sequence at the target locus) of the Cas13 guide sequence is approximately within the first 10 nucleotides of the guide sequence. In particular embodiments, the Cas13 is FnCas13 and the seed sequence is approximately within the first 5 nt on the 5' end of the guide sequence.

In a particular embodiment the guide molecule comprises a guide sequence linked to a direct repeat sequence, wherein the direct repeat sequence comprises one or more stem loops or optimized secondary structures. In particular embodiments, the direct repeat has a minimum length of 16 nts and a single stem loop. In further embodiments the direct repeat has a length longer than 16 nts, preferably more than 17 nts, and has more than one stem loops or optimized secondary structures. In particular embodiments the guide molecule comprises or consists of the guide sequence linked to all or part of the natural direct repeat sequence. A typical Type V Cas13 guide molecule comprises (in 3' to 5' direction): a guide sequence a first complimentary stretch (the "repeat"), a loop (which is typically 4 or 5 nucleotides long), a second complimentary stretch (the "anti-repeat" being complimentary to the repeat), and a poly A (often poly U in RNA) tail (terminator). In certain embodiments, the direct repeat sequence retains its natural architecture and forms a single stem loop. In particular embodiments, certain aspects of the guide architecture can be modified, for example by addition, subtraction, or substitution of features, whereas certain other aspects of guide architecture are maintained. Preferred locations for engineered guide molecule modifications, including but not limited to insertions, deletions, and substitutions include guide termini and regions of the guide molecule that are exposed when complexed with the Cas13 protein and/or target, for example the stem-loop of the direct repeat sequence.

In particular embodiments, the stem comprises at least about 4 bp comprising complementary X and Y sequences, although stems of more, e.g., 5, 6, 7, 8, 9, 10, 11 or 12 or fewer, e.g., 3, 2, base pairs are also contemplated. Thus, for example X2-10 and Y2-10 (wherein X and Y represent any complementary set of nucleotides) may be contemplated. In one aspect, the stem made of the X and Y nucleotides, together with the loop will form a complete hairpin in the overall secondary structure; and, this may be advantageous and the amount of base pairs can be any amount that forms a complete hairpin. In one aspect, any complementary X:Y base pairing sequence (e.g., as to length) is tolerated, so long as the secondary structure of the entire guide molecule is preserved. In one aspect, the loop that connects the stem made of X:Y base pairs can be any sequence of the same length (e.g., 4 or 5 nucleotides) or longer that does not interrupt the overall secondary structure of the guide molecule. In one aspect, the stem-loop can further comprise, e.g. an MS2 aptamer. In one aspect, the stem comprises about 5-7 bp comprising complementary X and Y sequences, although stems of more or fewer base pairs are also contemplated. In one aspect, non-Watson Crick base pairing is contemplated, where such pairing otherwise generally preserves the architecture of the stem-loop at that position.

In particular embodiments the natural hairpin or stem-loop structure of the guide molecule is extended or replaced by an extended stem-loop. It has been demonstrated that extension of the stem can enhance the assembly of the guide molecule with the CRISPR-Cas protein (Chen et al. Cell. (2013); 155(7): 1479-1491). In particular embodiments the stem of the stem-loop is extended by at least 1, 2, 3, 4, 5 or more complementary base pairs (i.e. corresponding to the addition of 2, 4, 6, 8, 10 or more nucleotides in the guide molecule). In particular embodiments these are located at the end of the stem, adjacent to the loop of the stem-loop.

In particular embodiments, the susceptibility of the guide molecule to RNAses or to decreased expression can be reduced by slight modifications of the sequence of the guide molecule which do not affect its function. For instance, in particular embodiments, premature termination of transcription, such as premature transcription of U6 Pol-III, can be removed by modifying a putative Pol-III terminator (4 consecutive U's) in the guide molecules sequence. Where such sequence modification is required in the stem-loop of the guide molecule, it is preferably ensured by a basepair flip.

In a preferred embodiment the direct repeat may be modified to comprise one or more protein-binding RNA aptamers. In a particular embodiment, one or more aptamers may be included such as part of optimized secondary structure. Such aptamers may be capable of binding a bacteriophage coat protein as detailed further herein.

In some embodiments, the guide molecule forms a duplex with a target DNA strand comprising at least one target adenosine residues to be edited. Upon hybridization of the guide RNA molecule to the target DNA strand, the adenosine deaminase binds to the duplex and catalyzes deamination of one or more target adenosine residues comprised within the DNA-RNA duplex.

A guide sequence, and hence a nucleic acid-targeting guide RNA may be selected to target any target nucleic acid sequence. The target sequence may be DNA. The target sequence may be genomic DNA. The target sequence may be mitochondrial DNA.

In certain embodiments, the target sequence should be associated with a PAM (protospacer adjacent motif) or PFS (protospacer flanking sequence or site); that is, a short sequence recognized by the CRISPR complex. Depending on the nature of the CRISPR-Cas protein, the target sequence should be selected such that its complementary sequence in the DNA duplex (also referred to herein as the non-target sequence) is upstream or downstream of the PAM. In the embodiments of the present invention where the CRISPR-Cas protein is a Cas13 protein, the complementary sequence of the target sequence in a is downstream or 3' of the PAM. The precise sequence and length requirements for the PAM differ depending on the Cas13 protein used, but PAMs are typically 2-5 base pair sequences adjacent the protospacer (that is, the target sequence). Examples of the natural PAM sequences for different Cas13 orthologues are provided herein below and the skilled person will be able to identify further PAM sequences for use with a given Cas13 protein.

Further, engineering of the PAM Interacting (PI) domain may allow programing of PAM specificity, improve target site recognition fidelity, and increase the versatility of the CRISPR-Cas protein, for example as described for Cas9 in Kleinstiver B P et al. Engineered CRISPR-Cas9 nucleases with altered PAM specificities. Nature. 2015 Jul. 23; 523 (7561):481-5. doi: 10.1038/nature14592. As further detailed herein, the skilled person will understand that Cas13 proteins may be modified analogously.

In particular embodiments, the guide sequence is selected in order to ensure optimal efficiency of the deaminase on the adenine to be deaminated. The position of the adenine in the target strand relative to the cleavage site of the Cas13 nickase may be taken into account. In particular embodiments it is of interest to ensure that the nickase will act in the vicinity of the adenine to be deaminated, on the non-target strand. For instance, in particular embodiments, the Cas13 nickase cuts the non-targeting strand 17 nucleotides downstream of the PAM (e.g. AsCas13, LbCas13) or 18 nucleotides downstream of the PAM (e.g. FnCas13), and it can be of interest to design the guide that the cytosine which is to correspond to the adenine to be deaminated is located in the guide sequence within 10 bp upstream or downstream of the nickase cleavage site in the sequence of the corresponding non-target strand.

In particular embodiment, the guide is an escorted guide. By "escorted" is meant that the Cas13 CRISPR-Cas system or complex or guide is delivered to a selected time or place within a cell, so that activity of the Cas13 CRISPR-Cas system or complex or guide is spatially or temporally controlled. For example, the activity and destination of the Cas13 CRISPR-Cas system or complex or guide may be controlled by an escort RNA aptamer sequence that has binding affinity for an aptamer ligand, such as a cell surface protein or other localized cellular component. Alternatively, the escort aptamer may for example be responsive to an aptamer effector on or in the cell, such as a transient effector, such as an external energy source that is applied to the cell at a particular time.

The escorted Cas13 CRISPR-Cas systems or complexes have a guide molecule with a functional structure designed to improve guide molecule structure, architecture, stability, genetic expression, or any combination thereof. Such a structure can include an aptamer.

Aptamers are biomolecules that can be designed or selected to bind tightly to other ligands, for example using a technique called systematic evolution of ligands by exponential enrichment (SELEX; Tuerk C, Gold L: "Systematic evolution of ligands by exponential enrichment: RNA ligands to bacteriophage T4 DNA polymerase." Science 1990, 249:505-510). Nucleic acid aptamers can for example be selected from pools of random-sequence oligonucleotides, with high binding affinities and specificities for a wide range of biomedically relevant targets, suggesting a wide range of therapeutic utilities for aptamers (Keefe, Anthony D., Supriya Pai, and Andrew Ellington. "Aptamers as therapeutics." Nature Reviews Drug Discovery 9.7 (2010): 537-550). These characteristics also suggest a wide range of uses for aptamers as drug delivery vehicles (Levy-Nissenbaum, Etgar, et al. "Nanotechnology and aptamers: applications in drug delivery." Trends in biotechnology 26.8 (2008): 442-449; and, Hicke B J, Stephens A W. "Escort aptamers: a delivery service for diagnosis and therapy." J Clin Invest 2000, 106:923-928.). Aptamers may also be constructed that function as molecular switches, responding to a que by changing properties, such as RNA aptamers that bind fluorophores to mimic the activity of green fluorescent protein (Paige, Jeremy S., Karen Y. Wu, and Samie R. Jaffrey. "RNA mimics of green fluorescent protein." Science 333.6042 (2011): 642-646). It has also been suggested that aptamers may be used as components of targeted siRNA therapeutic delivery systems, for example targeting cell surface proteins (Zhou, Jiehua, and John J. Rossi. "Aptamer-targeted cell-specific RNA interference." Silence 1.1 (2010): 4).

Accordingly, in particular embodiments, the guide molecule is modified, e.g., by one or more aptamer(s) designed to improve guide molecule delivery, including delivery across the cellular membrane, to intracellular compartments, or into the nucleus. Such a structure can include, either in addition to the one or more aptamer(s) or without such one or more aptamer(s), moiety(ies) so as to render the guide molecule deliverable, inducible or responsive to a selected effector. The invention accordingly comprehends an guide molecule that responds to normal or pathological physiological conditions, including without limitation pH, hypoxia, O2 concentration, temperature, protein concentration, enzymatic concentration, lipid structure, light exposure, mechanical disruption (e.g. ultrasound waves), magnetic fields, electric fields, or electromagnetic radiation.

Light responsiveness of an inducible system may be achieved via the activation and binding of cryptochrome-2 and CIB1. Blue light stimulation induces an activating conformational change in cryptochrome-2, resulting in recruitment of its binding partner CIB1. This binding is fast and reversible, achieving saturation in <15 sec following pulsed stimulation and returning to baseline <15 min after the end of stimulation. These rapid binding kinetics result in a system temporally bound only by the speed of transcription/translation and transcript/protein degradation, rather than uptake and clearance of inducing agents. Cryptochrome-2 activation is also highly sensitive, allowing for the use of low light intensity stimulation and mitigating the risks of phototoxicity. Further, in a context such as the intact mammalian brain, variable light intensity may be used to control the size of a stimulated region, allowing for greater precision than vector delivery alone may offer.

The invention contemplates energy sources such as electromagnetic radiation, sound energy or thermal energy to induce the guide. Advantageously, the electromagnetic radiation is a component of visible light. In a preferred embodiment, the light is a blue light with a wavelength of about 450 to about 495 nm. In an especially preferred embodiment, the wavelength is about 488 nm. In another preferred embodiment, the light stimulation is via pulses. The light power may range from about 0-9 mW/cm2. In a preferred embodiment, a stimulation paradigm of as low as 0.25 sec every 15 sec should result in maximal activation.

The chemical or energy sensitive guide may undergo a conformational change upon induction by the binding of a chemical source or by the energy allowing it act as a guide and have the Cas13 CRISPR-Cas system or complex function. The invention can involve applying the chemical source or energy so as to have the guide function and the Cas13 CRISPR-Cas system or complex function; and optionally further determining that the expression of the genomic locus is altered.

There are several different designs of this chemical inducible system: 1. ABI-PYL based system inducible by Abscisic Acid (ABA) (see, e.g., stke.sciencemag.org/cgi/content/abstract/sigtrans; 4/164/rs2), 2. FKBP-FRB based system inducible by rapamycin (or related chemicals based on rapamycin) (see, e.g., nature.com/nmeth/journal/v2/n6/full/nmeth763.html), 3. GID1-GAI based system inducible by Gibberellin (GA) (see, e.g., nature.com/nchembio/journal/v8/n5/full/nchembio.922.html).

A chemical inducible system can be an estrogen receptor (ER) based system inducible by 4-hydroxytamoxifen (4OHT) (see, e.g., pnas.org/content/104/3/1027.abstract). A mutated ligand-binding domain of the estrogen receptor called ERT2 translocates into the nucleus of cells upon binding of 4-hydroxytamoxifen. In further embodiments of the invention any naturally occurring or engineered derivative of any nuclear receptor, thyroid hormone receptor, retinoic acid receptor, estrogen receptor, estrogen-related receptor, glucocorticoid receptor, progesterone receptor, androgen receptor may be used in inducible systems analogous to the ER based inducible system.

Another inducible system is based on the design using Transient receptor potential (TRP) ion channel based system inducible by energy, heat or radio-wave (see, e.g., sciencemag.org/content/336/6081/604). These TRP family proteins respond to different stimuli, including light and heat. When this protein is activated by light or heat, the ion channel will open and allow the entering of ions such as calcium into the plasma membrane. This influx of ions will bind to intracellular ion interacting partners linked to a polypeptide including the guide and the other components of the Cas13 CRISPR-Cas complex or system, and the binding will induce the change of sub-cellular localization of the polypeptide, leading to the entire polypeptide entering the nucleus of cells. Once inside the nucleus, the guide protein and the other components of the Cas13 CRISPR-Cas complex will be active and modulating target gene expression in cells.

While light activation may be an advantageous embodiment, sometimes it may be disadvantageous especially for in vivo applications in which the light may not penetrate the skin or other organs. In this instance, other methods of energy activation are contemplated, in particular, electric field energy and/or ultrasound which have a similar effect.

Electric field energy is preferably administered substantially as described in the art, using one or more electric pulses of from about 1 Volt/cm to about 10 kVolts/cm under in vivo conditions. Instead of or in addition to the pulses, the electric field may be delivered in a continuous manner. The electric pulse may be applied for between 1 μs and 500 milliseconds, preferably between 1 μs and 100 milliseconds. The electric field may be applied continuously or in a pulsed manner for 5 about minutes.

As used herein, 'electric field energy' is the electrical energy to which a cell is exposed. Preferably the electric field has a strength of from about 1 Volt/cm to about 10 kVolts/cm or more under in vivo conditions (see WO97/49450).

As used herein, the term "electric field" includes one or more pulses at variable capacitance and voltage and including exponential and/or square wave and/or modulated wave and/or modulated square wave forms. References to electric fields and electricity should be taken to include reference the presence of an electric potential difference in the environment of a cell. Such an environment may be set up by way of static electricity, alternating current (AC), direct current (DC), etc, as known in the art. The electric field may be uniform, non-uniform or otherwise, and may vary in strength and/or direction in a time dependent manner.

Single or multiple applications of electric field, as well as single or multiple applications of ultrasound are also possible, in any order and in any combination. The ultrasound and/or the electric field may be delivered as single or multiple continuous applications, or as pulses (pulsatile delivery).

Electroporation has been used in both in vitro and in vivo procedures to introduce foreign material into living cells. With in vitro applications, a sample of live cells is first mixed with the agent of interest and placed between electrodes such as parallel plates. Then, the electrodes apply an electrical field to the cell/implant mixture. Examples of systems that perform in vitro electroporation include the Electro Cell Manipulator ECM600 product, and the Electro Square Porator T820, both made by the BTX Division of Genetronics, Inc (see U.S. Pat. No. 5,869,326).

The known electroporation techniques (both in vitro and in vivo) function by applying a brief high voltage pulse to electrodes positioned around the treatment region. The electric field generated between the electrodes causes the cell membranes to temporarily become porous, whereupon molecules of the agent of interest enter the cells. In known electroporation applications, this electric field comprises a single square wave pulse on the order of 1000 V/cm, of about 100 .mu.s duration. Such a pulse may be generated, for example, in known applications of the Electro Square Porator T820.

Preferably, the electric field has a strength of from about 1 V/cm to about 10 kV/cm under in vitro conditions. Thus, the electric field may have a strength of 1 V/cm, 2 V/cm, 3 V/cm, 4 V/cm, 5 V/cm, 6 V/cm, 7 V/cm, 8 V/cm, 9 V/cm, 10 V/cm, 20 V/cm, 50 V/cm, 100 V/cm, 200 V/cm, 300 V/cm, 400 V/cm, 500 V/cm, 600 V/cm, 700 V/cm, 800 V/cm, 900 V/cm, 1 kV/cm, 2 kV/cm, 5 kV/cm, 10 kV/cm, 20 kV/cm, 50 kV/cm or more. More preferably from about 0.5 kV/cm to about 4.0 kV/cm under in vitro conditions. Preferably the electric field has a strength of from about 1 V/cm to about 10 kV/cm under in vivo conditions. However, the electric field strengths may be lowered where the number of pulses delivered to the target site are increased. Thus, pulsatile delivery of electric fields at lower field strengths is envisaged.

Preferably the application of the electric field is in the form of multiple pulses such as double pulses of the same strength and capacitance or sequential pulses of varying strength and/or capacitance. As used herein, the term "pulse" includes one or more electric pulses at variable capacitance and voltage and including exponential and/or square wave and/or modulated wave/square wave forms.

Preferably the electric pulse is delivered as a waveform selected from an exponential wave form, a square wave form, a modulated wave form and a modulated square wave form.

A preferred embodiment employs direct current at low voltage. Thus, Applicants disclose the use of an electric field which is applied to the cell, tissue or tissue mass at a field strength of between 1V/cm and 20V/cm, for a period of 100 milliseconds or more, preferably 15 minutes or more.

Ultrasound is advantageously administered at a power level of from about 0.05 W/cm2 to about 100 W/cm2. Diagnostic or therapeutic ultrasound may be used, or combinations thereof.

As used herein, the term "ultrasound" refers to a form of energy which consists of mechanical vibrations the frequencies of which are so high they are above the range of human hearing. Lower frequency limit of the ultrasonic spectrum may generally be taken as about 20 kHz. Most diagnostic applications of ultrasound employ frequencies in the range 1 and 15 MHz' (From Ultrasonics in Clinical Diagnosis, P. N. T. Wells, ed., 2nd. Edition, Publ. Churchill Livingstone [Edinburgh, London & NY, 1977]).

Ultrasound has been used in both diagnostic and therapeutic applications. When used as a diagnostic tool ("diagnostic ultrasound"), ultrasound is typically used in an energy density range of up to about 100 mW/cm2 (FDA recommendation), although energy densities of up to 750 mW/cm2 have been used. In physiotherapy, ultrasound is typically used as an energy source in a range up to about 3 to 4 W/cm2 (WHO recommendation). In other therapeutic applications, higher intensities of ultrasound may be employed, for example, HIFU at 100 W/cm up to 1 kW/cm2 (or even higher) for short periods of time. The term "ultrasound" as used in this specification is intended to encompass diagnostic, therapeutic and focused ultrasound.

Focused ultrasound (FUS) allows thermal energy to be delivered without an invasive probe (see Morocz et al 1998 Journal of Magnetic Resonance Imaging Vol. 8, No. 1, pp. 136-142. Another form of focused ultrasound is high intensity focused ultrasound (HIFU) which is reviewed by Moussatov et al in Ultrasonics (1998) Vol. 36, No. 8, pp. 893-900 and TranHuuHue et al in Acustica (1997) Vol. 83, No. 6, pp. 1103-1106.

Preferably, a combination of diagnostic ultrasound and a therapeutic ultrasound is employed. This combination is not intended to be limiting, however, and the skilled reader will appreciate that any variety of combinations of ultrasound may be used. Additionally, the energy density, frequency of ultrasound, and period of exposure may be varied.

Preferably the exposure to an ultrasound energy source is at a power density of from about 0.05 to about 100 Wcm-2. Even more preferably, the exposure to an ultrasound energy source is at a power density of from about 1 to about 15 Wcm-2.

Preferably the exposure to an ultrasound energy source is at a frequency of from about 0.015 to about 10.0 MHz. More preferably the exposure to an ultrasound energy source is at a frequency of from about 0.02 to about 5.0 MHz or about 6.0 MHz. Most preferably, the ultrasound is applied at a frequency of 3 MHz.

Preferably the exposure is for periods of from about 10 milliseconds to about 60 minutes. Preferably the exposure is for periods of from about 1 second to about 5 minutes. More preferably, the ultrasound is applied for about 2 minutes. Depending on the particular target cell to be disrupted, however, the exposure may be for a longer duration, for example, for 15 minutes.

Advantageously, the target tissue is exposed to an ultrasound energy source at an acoustic power density of from about 0.05 Wcm-2 to about 10 Wcm-2 with a frequency ranging from about 0.015 to about 10 MHz (see WO 98/52609). However, alternatives are also possible, for example, exposure to an ultrasound energy source at an acoustic power density of above 100 Wcm-2, but for reduced periods of time, for example, 1000 Wcm-2 for periods in the millisecond range or less.

Preferably the application of the ultrasound is in the form of multiple pulses; thus, both continuous wave and pulsed wave (pulsatile delivery of ultrasound) may be employed in any combination. For example, continuous wave ultrasound may be applied, followed by pulsed wave ultrasound, or vice versa. This may be repeated any number of times, in any order and combination. The pulsed wave ultrasound may be applied against a background of continuous wave ultrasound, and any number of pulses may be used in any number of groups.

Preferably, the ultrasound may comprise pulsed wave ultrasound. In a highly preferred embodiment, the ultrasound is applied at a power density of 0.7 Wcm-2 or 1.25 Wcm-2 as a continuous wave. Higher power densities may be employed if pulsed wave ultrasound is used.

Use of ultrasound is advantageous as, like light, it may be focused accurately on a target. Moreover, ultrasound is advantageous as it may be focused more deeply into tissues unlike light. It is therefore better suited to whole-tissue penetration (such as but not limited to a lobe of the liver) or whole organ (such as but not limited to the entire liver or an entire muscle, such as the heart) therapy. Another important advantage is that ultrasound is a non-invasive stimulus which is used in a wide variety of diagnostic and therapeutic applications. By way of example, ultrasound is well known in medical imaging techniques and, additionally, in orthopedic therapy. Furthermore, instruments suitable for the application of ultrasound to a subject vertebrate are widely available and their use is well known in the art.

In particular embodiments, the guide molecule is modified by a secondary structure to increase the specificity of the CRISPR-Cas system and the secondary structure can protect against exonuclease activity and allow for 5' additions to the guide sequence also referred to herein as a protected guide molecule.

In one aspect, the invention provides for hybridizing a "protector RNA" to a sequence of the guide molecule, wherein the "protector RNA" is an RNA strand complementary to the 3' end of the guide molecule to thereby generate a partially double-stranded guide RNA. In an embodiment of the invention, protecting mismatched bases (i.e. the bases of the guide molecule which do not form part of the guide sequence) with a perfectly complementary protector sequence decreases the likelihood of target DNA binding to the mismatched base pairs at the 3' end. In particular embodiments of the invention, additional sequences comprising an extended length may also be present within the guide molecule such that the guide comprises a protector sequence within the guide molecule. This "protector sequence" ensures that the guide molecule comprises a "protected sequence" in addition to an "exposed sequence" (comprising the part of the guide sequence hybridizing to the target sequence). In particular embodiments, the guide molecule is modified by the presence of the protector guide to comprise a secondary structure such as a hairpin. Advantageously there are three or four to thirty or more, e.g., about 10 or more, contiguous base pairs having complementarity to the protected sequence, the guide sequence or both. It is advantageous that the protected portion does not impede thermodynamics of the CRISPR-Cas system interacting with its target. By providing such an extension including a partially double stranded guide molecule, the guide molecule is considered protected and results in improved specific binding of the CRISPR-Cas complex, while maintaining specific activity.

In particular embodiments, use is made of a truncated guide (tru-guide), i.e. a guide molecule which comprises a guide sequence which is truncated in length with respect to the canonical guide sequence length. As described by Nowak et al. (Nucleic Acids Res (2016) 44 (20): 9555-9564), such guides may allow catalytically active CRISPR-Cas enzyme to bind its target without cleaving the target DNA. In particular embodiments, a truncated guide is used which allows the binding of the target but retains only nickase activity of the CRISPR-Cas enzyme.

Crispr-Cas Enzyme

In its unmodified form, a CRISPR-Cas protein is a catalytically active protein. This implies that upon formation of a nucleic acid-targeting complex (comprising a guide RNA hybridized to a target sequence one or both DNA strands in or near (e.g., within 1, 2, 3, 4, 5, 6, 7, 8, 9, 10, 20, 50, or more base pairs from) the target sequence is modified (e.g.

cleaved). As used herein the term "sequence(s) associated with a target locus of interest" refers to sequences near the vicinity of the target sequence (e.g. within 1, 2, 3, 4, 5, 6, 7, 8, 9, 10, 20, 50, or more base pairs from the target sequence, wherein the target sequence is comprised within a target locus of interest). The unmodified catalytically active Cas13 protein generates a staggered cut, whereby the cut sites are typically within the target sequence. More particularly, the staggered cut is typically 13-23 nucleotides distal to the PAM. In particular embodiments, the cut on the non-target strand is 17 nucleotides downstream of the PAM (i.e. between nucleotide 17 and 18 downstream of the PAM), while the cut on the target strand (i.e. strand hybridizing with the guide sequence) occurs a further 4 nucleotides further from the sequence complementary to the PAM (this is 21 nucleotides upstream of the complement of the PAM on the 3' strand or between nucleotide 21 and 22 upstream of the complement of the PAM).

In the methods according to the present invention, the CRISPR-Cas protein is preferably mutated with respect to a corresponding wild-type enzyme such that the mutated CRISPR-Cas protein lacks the ability to cleave one or both DNA strands of a target locus containing a target sequence. In particular embodiments, one or more catalytic domains of the Cas13 protein are mutated to produce a mutated Cas protein which cleaves only one DNA strand of a target sequence.

In particular embodiments, the CRISPR-Cas protein may be mutated with respect to a corresponding wild-type enzyme such that the mutated CRISPR-Cas protein lacks substantially all DNA cleavage activity. In some embodiments, a CRISPR-Cas protein may be considered to substantially lack all DNA and/or RNA cleavage activity when the cleavage activity of the mutated enzyme is about no more than 25%, 10%, 5%, 1%, 0.1%, 0.01%, or less of the nucleic acid cleavage activity of the non-mutated form of the enzyme; an example can be when the nucleic acid cleavage activity of the mutated form is nil or negligible as compared with the non-mutated form.

In certain embodiments of the methods provided herein the CRISPR-Cas protein is a mutated CRISPR-Cas protein which cleaves only one DNA strand, i.e. a nickase. More particularly, in the context of the present invention, the nickase ensures cleavage within the non-target sequence, i.e. the sequence which is on the opposite DNA strand of the target sequence and which is 3' of the PAM sequence. By means of further guidance, and without limitation, an arginine-to-alanine substitution (R1226A) in the Nuc domain of Cas13 from *Acidaminococcus* sp. converts Cas13 from a nuclease that cleaves both strands to a nickase (cleaves a single strand). It will be understood by the skilled person that where the enzyme is not AsCas13, a mutation may be made at a residue in a corresponding position. In particular embodiments, the Cas13 is FnCas13 and the mutation is at the arginine at position R1218. In particular embodiments, the Cas13 is LbCas13 and the mutation is at the arginine at position R1138. In particular embodiments, the Cas13 is MbCas13 and the mutation is at the arginine at position R1293.

In certain embodiments of the methods provided herein the CRISPR-Cas protein has reduced or no catalytic activity. Where the CRISPR-Cas protein is a Cas13 protein, the mutations may include but are not limited to one or more mutations in the catalytic RuvC-like domain, such as D908A or E993A with reference to the positions in AsCas13.

In some embodiments, a CRISPR-Cas protein is considered to substantially lack all DNA cleavage activity when the DNA cleavage activity of the mutated enzyme is about no more than 25%, 10%, 5%, 1%, 0.1%, 0.01%, or less of the DNA cleavage activity of the non-mutated form of the enzyme; an example can be when the DNA cleavage activity of the mutated form is nil or negligible as compared with the non-mutated form. In these embodiments, the CRISPR-Cas protein is used as a generic DNA binding protein. The mutations may be artificially introduced mutations or gain- or loss-of-function mutations.

In addition to the mutations described above, the CRISPR-Cas protein may be additionally modified. As used herein, the term "modified" with regard to a CRISPR-Cas protein generally refers to a CRISPR-Cas protein having one or more modifications or mutations (including point mutations, truncations, insertions, deletions, chimeras, fusion proteins, etc.) compared to the wild type Cas protein from which it is derived. By derived is meant that the derived enzyme is largely based, in the sense of having a high degree of sequence homology with, a wildtype enzyme, but that it has been mutated (modified) in some way as known in the art or as described herein.

Figure 67:
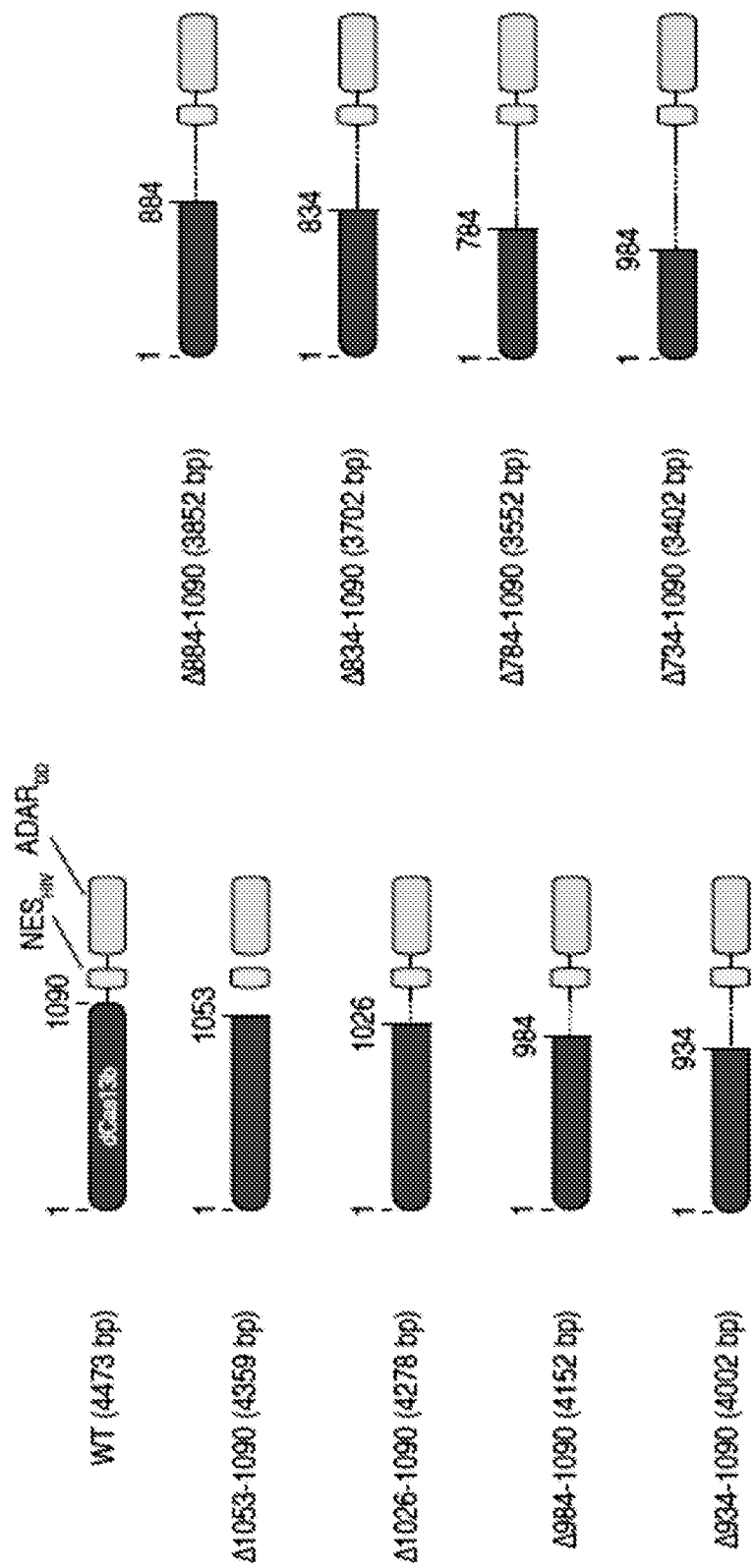
FIG. 67: Additional truncations of Psp dCas13b.

In some embodiments, to reduce the size of a fusion protein of the Cas13b effector and the one or more functional domains, the C-terminus of the Cas13b effector can be truncated while still maintaining its RNA binding function. For example, at least 20 amino acids, at least 50 amino acids, at least 80 amino acids, or at least 100 amino acids, or at least 150 amino acids, or at least 200 amino acids, or at least 250 amino acids, or at least 300 amino acids, or at least 350 amino acids, or up to 120 amino acids, or up to 140 amino acids, or up to 160 amino acids, or up to 180 amino acids, or up to 200 amino acids, or up to 250 amino acids, or up to 300 amino acids, or up to 350 amino acids, or up to 400 amino acids, may be truncated at the C-terminus of the Cas13b effector. Specific examples of Cas13b truncations include C-terminal A984-1090, C-terminal A1026-1090, and C-terminal A1053-1090, C-terminal A934-1090, C-terminal A884-1090, C-terminal A834-1090, C-terminal A784-1090, and C-terminal A734-1090, wherein amino acid positions correspond to amino acid positions of *Prevotella* sp. P5-125 Cas13b protein. See also FIG. 67.

The additional modifications of the CRISPR-Cas protein may or may not cause an altered functionality. By means of example, and in particular with reference to CRISPR-Cas protein, modifications which do not result in an altered functionality include for instance codon optimization for expression into a particular host, or providing the nuclease with a particular marker (e.g. for visualization). Modifications with may result in altered functionality may also include mutations, including point mutations, insertions, deletions, truncations (including split nucleases), etc. Fusion proteins may without limitation include for instance fusions with heterologous domains or functional domains (e.g. localization signals, catalytic domains, etc.). In certain embodiments, various different modifications may be combined (e.g. a mutated nuclease which is catalytically inactive and which further is fused to a functional domain, such as for instance to induce DNA methylation or another nucleic acid modification, such as including without limitation a break (e.g. by a different nuclease (domain)), a mutation, a deletion, an insertion, a replacement, a ligation, a digestion, a break or a recombination). As used herein, "altered functionality" includes without limitation an altered specificity (e.g. altered target recognition, increased (e.g. "enhanced" Cas proteins) or decreased specificity, or altered PAM recognition), altered activity (e.g. increased or decreased catalytic activity, including catalytically inactive nucleases or nickases), and/or altered stability (e.g. fusions with destabilization domains). Suitable heterologous domains include without limitation a nuclease, a ligase, a repair protein, a methyltransferase, (viral) integrase, a recombinase, a transposase, an argonaute, a cytidine deaminase, a retron, a group II intron, a phosphatase, a phosphorylase, a sulfurylase, a kinase, a polymerase, an exonuclease, etc. Examples of all these modifications are known in the art. It will be understood that a "modified" nuclease as referred to herein, and in particular a "modified" Cas or "modified" CRISPR-Cas system or complex preferably still has the capacity to interact with or bind to the polynucleic acid (e.g. in complex with the guide molecule). Such modified Cas protein can be combined with the deaminase protein or active domain thereof as described herein.

In certain embodiments, CRISPR-Cas protein may comprise one or more modifications resulting in enhanced activity and/or specificity, such as including mutating residues that stabilize the targeted or non-targeted strand (e.g. eCas9; "Rationally engineered Cas9 nucleases with improved specificity", Slaymaker et al. (2016), Science, 351(6268): 84-88, incorporated herewith in its entirety by reference). In certain embodiments, the altered or modified activity of the engineered CRISPR protein comprises increased targeting efficiency or decreased off-target binding. In certain embodiments, the altered activity of the engineered CRISPR protein comprises modified cleavage activity. In certain embodiments, the altered activity comprises increased cleavage activity as to the target polynucleotide loci. In certain embodiments, the altered activity comprises decreased cleavage activity as to the target polynucleotide loci. In certain embodiments, the altered activity comprises decreased cleavage activity as to off-target polynucleotide loci. In certain embodiments, the altered or modified activity of the modified nuclease comprises altered helicase kinetics. In certain embodiments, the modified nuclease comprises a modification that alters association of the protein with the nucleic acid molecule comprising RNA (in the case of a Cas protein), or a strand of the target polynucleotide loci, or a strand of off-target polynucleotide loci. In an aspect of the invention, the engineered CRISPR protein comprises a modification that alters formation of the CRISPR complex. In certain embodiments, the altered activity comprises increased cleavage activity as to off-target polynucleotide loci. Accordingly, in certain embodiments, there is increased specificity for target polynucleotide loci as compared to off-target polynucleotide loci. In other embodiments, there is reduced specificity for target polynucleotide loci as compared to off-target polynucleotide loci. In certain embodiments, the mutations result in decreased off-target effects (e.g. cleavage or binding properties, activity, or kinetics), such as in case for Cas proteins for instance resulting in a lower tolerance for mismatches between target and guide RNA. Other mutations may lead to increased off-target effects (e.g. cleavage or binding properties, activity, or kinetics). Other mutations may lead to increased or decreased on-target effects (e.g. cleavage or binding properties, activity, or kinetics). In certain embodiments, the mutations result in altered (e.g. increased or decreased) helicase activity, association or formation of the functional nuclease complex (e.g. CRISPR-Cas complex). In certain embodiments, as described above, the mutations result in an altered PAM recognition, i.e. a different PAM may be (in addition or in the alternative) be recognized, compared to the unmodified Cas protein. Particularly preferred mutations include positively charged residues and/or (evolutionary) conserved residues, such as conserved positively charged residues, in order to enhance specificity. In certain embodiments, such residues may be mutated to uncharged residues, such as alanine.

Base Excision Repair Inhibitor

In some embodiments, the AD-functionalized CRISPR system further comprises a base excision repair (BER) inhibitor. Without wishing to be bound by any particular theory, cellular DNA-repair response to the presence of I:T pairing may be responsible for a decrease in nucleobase editing efficiency in cells. Alkyladenine DNA glycosylase (also known as DNA-3-methyladenine glycosylase, 3-alkyladenine DNA glycosylase, or N-methylpurine DNA glycosylase) catalyzes removal of hypoxanthine from DNA in cells, which may initiate base excision repair, with reversion of the I:T pair to a A:T pair as outcome.

In some embodiments, the BER inhibitor is an inhibitor of alkyladenine DNA glycosylase. In some embodiments, the BER inhibitor is an inhibitor of human alkyladenine DNA glycosylase. In some embodiments, the BER inhibitor is a polypeptide inhibitor. In some embodiments, the BER inhibitor is a protein that binds hypoxanthine. In some embodiments, the BER inhibitor is a protein that binds hypoxanthine in DNA. In some embodiments, the BER inhibitor is a catalytically inactive alkyladenine DNA glycosylase protein or binding domain thereof. In some embodiments, the BER inhibitor is a catalytically inactive alkyladenine DNA glycosylase protein or binding domain thereof that does not excise hypoxanthine from the DNA. Other proteins that are capable of inhibiting (e.g., sterically blocking) an alkyladenine DNA glycosylase base-excision repair enzyme are within the scope of this disclosure. Additionally, any proteins that block or inhibit base-excision repair as also within the scope of this disclosure.

Without wishing to be bound by any particular theory, base excision repair may be inhibited by molecules that bind the edited strand, block the edited base, inhibit alkyladenine DNA glycosylase, inhibit base excision repair, protect the edited base, and/or promote fixing of the non-edited strand. It is believed that the use of the BER inhibitor described herein can increase the editing efficiency of an adenosine deaminase that is capable of catalyzing a A to I change.

Accordingly, in the first design of the AD-functionalized CRISPR system discussed above, the CRISPR-Cas protein or the adenosine deaminase can be fused to or linked to a BER inhibitor (e.g., an inhibitor of alkyladenine DNA glycosylase). In some embodiments, the BER inhibitor can be comprised in one of the following structures (nCas13=Cas13 nickase; dCas13=dead Cas13); [AD]-[optional linker]-[nCas13/dCas13]-[optional linker]-[BER inhibitor]; [AD]-[optional linker]-[BER inhibitor]-[optional linker]-[nCas13/dCas13]; [BER inhibitor]-[optional linker]-[AD]-[optional linker]-[nCas13/dCas13]; [BER inhibitor]-[optional linker]-[nCas13/dCas13]-[optional linker]-[AD]; [nCas13/dCas13]-[optional linker]-[AD]-[optional linker]-[BER inhibitor]; [nCas13/dCas13]-[optional linker]-[BER inhibitor]-[optional linker]-[AD].

Similarly, in the second design of the AD-functionalized CRISPR system discussed above, the CRISPR-Cas protein, the adenosine deaminase, or the adaptor protein can be fused to or linked to a BER inhibitor (e.g., an inhibitor of alkyladenine DNA glycosylase). In some embodiments, the BER inhibitor can be comprised in one of the following structures (nCas13=Cas13 nickase; dCas13=dead Cas13): [nCas13/dCas13]-[optional linker]-[BER inhibitor]; [BER inhibitor]-[optional linker]-[nCas13/dCas13]; [AD]-[optional linker]-[Adaptor]-[optional linker]-[BER inhibitor]; [AD]-[optional linker]-[BER inhibitor]-[optional linker]-[Adaptor]; [BER inhibitor]-[optional linker]-[AD]-[optional linker]-[Adaptor]; [BER inhibitor]-[optional linker]-[Adaptor]-[optional linker]-[AD]; [Adaptor]-[optional linker]-[AD]-[optional linker]-[BER inhibitor]; [Adaptor]-[optional linker]-[BER inhibitor]-[optional linker]-[AD].

In the third design of the AD-functionalized CRISPR system discussed above, the BER inhibitor can be inserted into an internal loop or unstructured region of a CRISPR-Cas protein.

Targeting to the Nucleus

In some embodiments, the methods of the present invention relate to modifying an Adenine in a target locus of interest, whereby the target locus is within a cell. In order to improve targeting of the CRISPR-Cas protein and/or the adenosine deaminase protein or catalytic domain thereof used in the methods of the present invention to the nucleus, it may be advantageous to provide one or both of these components with one or more nuclear localization sequences (NLSs).

In preferred embodiments, the NLSs used in the context of the present invention are heterologous to the proteins. Non-limiting examples of NLSs include an NLS sequence derived from: the NLS of the SV40 virus large T-antigen, having the amino acid sequence PKKKRKV (SEQ ID No. 17) or PKKKRKVEAS (SEQ ID No. 18); the NLS from nucleoplasmin (e.g., the nucleoplasmin bipartite NLS with the sequence KRPAATKKAGQAKKKK (SEQ ID No. 19)); the c-myc NLS having the amino acid sequence PAAKRVKLD (SEQ ID No. 20) or RQRRNELKRSP (SEQ ID No. 21); the hRNPA1 M9 NLS having the sequence NQSSNFGPMKGGNFGGRSSGPYGGGGQYFAK-PRNQGGY (SEQ ID No. 22); the sequence RMRIZFKNKGKDTAELRRRRVEVSVELRKAKKD-EQILKRRNV (SEQ ID No. 23) of the IBB domain from importin-alpha; the sequences VSRKRPRP (SEQ ID No. 24) and PPKKARED (SEQ ID No. 25) of the myoma T protein; the sequence PQPKKKPL (SEQ ID No. 26) of human p53; the sequence SALIKKKKKMAP (SEQ ID No. 27) of mouse c-abl IV; the sequences DRLRR (SEQ ID No. 28) and PKQKKRK (SEQ ID No. 29) of the influenza virus NS1; the sequence RKLKKKIKKL (SEQ ID No. 30) of the Hepatitis virus delta antigen; the sequence REKKKFLKRR (SEQ ID No. 31) of the mouse Mx1 protein; the sequence KRKGDEVDGVDEVAKKKSKK (SEQ ID No. 32) of the human poly(ADP-ribose) polymerase; and the sequence RKCLQAGMNLEARKTKK (SEQ ID No. 33) of the steroid hormone receptors (human) glucocorticoid. In general, the one or more NLSs are of sufficient strength to drive accumulation of the DNA-targeting Cas protein in a detectable amount in the nucleus of a eukaryotic cell. In general, strength of nuclear localization activity may derive from the number of NLSs in the CRISPR-Cas protein, the particular NLS(s) used, or a combination of these factors. Detection of accumulation in the nucleus may be performed by any suitable technique. For example, a detectable marker may be fused to the nucleic acid-targeting protein, such that location within a cell may be visualized, such as in combination with a means for detecting the location of the nucleus (e.g., a stain specific for the nucleus such as DAPI). Cell nuclei may also be isolated from cells, the contents of which may then be analyzed by any suitable process for detecting protein, such as immunohistochemistry, Western blot, or enzyme activity assay. Accumulation in the nucleus may also be determined indirectly, such as by an assay for the effect of nucleic acid-targeting complex formation (e.g., assay for deaminase activity) at the target sequence, or assay for altered gene expression activity affected by DNA-targeting complex formation and/or DNA-targeting), as compared to a control not exposed to the CRISPR-Cas protein and deaminase protein, or exposed to a CRISPR-Cas and/or deaminase protein lacking the one or more NLSs.

The CRISPR-Cas and/or adenosine deaminase proteins may be provided with 1 or more, such as with, 2, 3, 4, 5, 6, 7, 8, 9, 10, or more heterologous NLSs. In some embodiments, the proteins comprises about or more than about 1, 2, 3, 4, 5, 6, 7, 8, 9, 10, or more NLSs at or near the amino-terminus, about or more than about 1, 2, 3, 4, 5, 6, 7, 8, 9, 10, or more NLSs at or near the carboxy-terminus, or a combination of these (e.g., zero or at least one or more NLS at the amino-terminus and zero or at one or more NLS at the carboxy terminus). When more than one NLS is present, each may be selected independently of the others, such that a single NLS may be present in more than one copy and/or in combination with one or more other NLSs present in one or more copies. In some embodiments, an NLS is considered near the N- or C-terminus when the nearest amino acid of the NLS is within about 1, 2, 3, 4, 5, 10, 15, 20, 25, 30, 40, 50, or more amino acids along the polypeptide chain from the N- or C-terminus. In preferred embodiments of the CRISPR-Cas proteins, an NLS attached to the C-terminal of the protein.

In certain embodiments of the methods provided herein, the CRISPR-Cas protein and the deaminase protein are delivered to the cell or expressed within the cell as separate proteins. In these embodiments, each of the CRISPR-Cas and deaminase protein can be provided with one or more NLSs as described herein. In certain embodiments, the CRISPR-Cas and deaminase proteins are delivered to the cell or expressed with the cell as a fusion protein. In these embodiments one or both of the CRISPR-Cas and deaminase protein is provided with one or more NLSs. Where the adenosine deaminase is fused to an adaptor protein (such as MS2) as described above, the one or more NLS can be provided on the adaptor protein, provided that this does not interfere with aptamer binding. In particular embodiments, the one or more NLS sequences may also function as linker sequences between the adenosine deaminase and the CRISPR-Cas protein.

In certain embodiments, guides of the invention comprise specific binding sites (e.g. aptamers) for adapter proteins, which may be linked to or fused to an adenosine deaminase or catalytic domain thereof. When such a guides forms a CRISPR complex (i.e. CRISPR-Cas protein binding to guide and target) the adapter proteins bind and, the adenosine deaminase or catalytic domain thereof associated with the adapter protein is positioned in a spatial orientation which is advantageous for the attributed function to be effective.

The skilled person will understand that modifications to the guide which allow for binding of the adapter+adenosine deaminase, but not proper positioning of the adapter+adenosine deaminase (e.g. due to steric hindrance within the three dimensional structure of the CRISPR complex) are modifications which are not intended. The one or more modified guide may be modified at the tetra loop, the stem loop 1, stem loop 2, or stem loop 3, as described herein, preferably at either the tetra loop or stem loop 2, and most preferably at both the tetra loop and stem loop 2.

Use of Orthogonal Catalytically Inactive CRISPR-Cas Proteins

In particular embodiments, the Cas13 nickase is used in combination with an orthogonal catalytically inactive CRISPR-Cas protein to increase efficiency of said Cas13 nickase (as described in Chen et al. 2017, Nature Communications 8:14958; doi:10.1038/ncomms14958). More particularly, the orthogonal catalytically inactive CRISPR-Cas protein is characterized by a different PAM recognition site than the Cas13 nickase used in the AD-functionalized CRISPR system and the corresponding guide sequence is selected to bind to a target sequence proximal to that of the Cas13 nickase of the AD-functionalized CRISPR system. The orthogonal catalytically inactive CRISPR-Cas protein as used in the context of the present invention does not form part of the AD-functionalized CRISPR system but merely functions to increase the efficiency of said Cas13 nickase and is used in combination with a standard guide molecule as described in the art for said CRISPR-Cas protein. In particular embodiments, said orthogonal catalytically inactive CRISPR-Cas protein is a dead CRISPR-Cas protein, i.e. comprising one or more mutations which abolishes the nuclease activity of said CRISPR-Cas protein. In particular embodiments, the catalytically inactive orthogonal CRISPR-Cas protein is provided with two or more guide molecules which are capable of hybridizing to target sequences which are proximal to the target sequence of the Cas13 nickase. In particular embodiments, at least two guide molecules are used to target said catalytically inactive CRISPR-Cas protein, of which at least one guide molecule is capable of hybridizing to a target sequence 5" of the target sequence of the Cas13 nickase and at least one guide molecule is capable of hybridizing to a target sequence 3' of the target sequence of the Cas13 nickase of the AD-functionalized CRISPR system, whereby said one or more target sequences may be on the same or the opposite DNA strand as the target sequence of the Cas13 nickase. In particular embodiments, the guide sequences for the one or more guide molecules of the orthogonal catalytically inactive CRISPR-Cas protein are selected such that the target sequences are proximal to that of the guide molecule for the targeting of the AD-functionalized CRISPR, i.e. for the targeting of the Cas13 nickase. In particular embodiments, the one or more target sequences of the orthogonal catalytically inactive CRISPR-Cas enzyme are each separated from the target sequence of the Cas13 nickase by more than 5 but less than 450 base pairs. Optimal distances between the target sequences of the guides for use with the orthogonal catalytically inactive CRISPR-Cas protein and the target sequence of the AD-functionalized CRISPR system can be determined by the skilled person. In particular embodiments, the orthogonal CRISPR-Cas protein is a Class II, type II CRISPR protein. In particular embodiments, the orthogonal CRISPR-Cas protein is a Class II, type V CRISPR protein. In particular embodiments, the catalytically inactive orthogonal CRISPR-Cas protein In particular embodiments, the catalytically inactive orthogonal CRISPR-Cas protein has been modified to alter its PAM specificity as described elsewhere herein. In particular embodiments, the Cas13 protein nickase is a nickase which, by itself has limited activity in human cells, but which, in combination with an inactive orthogonal CRISPR-Cas protein and one or more corresponding proximal guides ensures the required nickase activity.

CRISPR Development and Use

The present invention may be further illustrated and extended based on aspects of CRISPR-Cas development and use as set forth in the following articles and particularly as relates to delivery of a CRISPR protein complex and uses of an RNA guided endonuclease in cells and organisms:

Multiplex genome engineering using CRISPR-Cas systems. Cong, L., Ran, F. A., Cox, D., Lin, S., Barretto, R., Habib, N., Hsu, P. D., Wu, X., Jiang, W., Marraffini, L. A., & Zhang, F. Science February 15; 339(6121):819-23 (2013);

RNA-guided editing of bacterial genomes using CRISPR-Cas systems. Jiang W., Bikard D., Cox D., Zhang F, Marraffini L A. Nat Biotechnol March; 31(3):233-9 (2013);

One-Step Generation of Mice Carrying Mutations in Multiple Genes by CRISPR-Cas-Mediated Genome Engineering. Wang H., Yang H., Shivalila C S., Dawlaty M M., Cheng A W., Zhang F., Jaenisch R. Cell May 9; 153(4): 910-8 (2013);

Optical control of mammalian endogenous transcription and epigenetic states. Konermann S, Brigham M D, Trevino A E, Hsu P D, Heidenreich M, Cong L, Platt R J, Scott D A, Church G M, Zhang F. Nature. August 22; 500(7463): 472-6. doi: 10.1038/Nature12466. Epub 2013 Aug. 23 (2013);

Double Nicking by RNA-Guided CRISPR Cas9 for Enhanced Genome Editing Specificity. Ran, F A., Hsu, P D., Lin, C Y., Gootenberg, J S., Konermann, S., Trevino, A E., Scott, D A., Inoue, A., Matoba, S., Zhang, Y., & Zhang, F. Cell August 28. pii: S0092-8674(13)01015-5 (2013-A);

DNA targeting specificity of RNA-guided Cas9 nucleases. Hsu, P., Scott, D., Weinstein, J., Ran, F A., Konermann, S., Agarwala, V., Li, Y., Fine, E., Wu, X., Shalem, O., Cradick, T J., Marraffini, L A., Bao, G., & Zhang, F. Nat Biotechnol doi:10.1038/nbt.2647 (2013);

Genome engineering using the CRISPR-Cas9 system. Ran, F A., Hsu, P D., Wright, J., Agarwala, V., Scott, D A., Zhang, F. Nature Protocols November; 8(11):2281-308 (2013-B);

Genome-Scale CRISPR-Cas9 Knockout Screening in Human Cells. Shalem, O., Sanjana, N E., Hartenian, E., Shi, X., Scott, D A., Mikkelson, T., Heckl, D., Ebert, B L., Root, D E., Doench, J G., Zhang, F. Science December 12. (2013);

Crystal structure of cas9 in complex with guide RNA and target DNA. Nishimasu, H., Ran, F A., Hsu, P D., Konermann, S., Shehata, S I., Dohmae, N., Ishitani, R., Zhang, F., Nureki, O. Cell February 27, 156(5):935-49 (2014);

Genome-wide binding of the CRISPR endonuclease Cas9 in mammalian cells. Wu X., Scott D A., Kriz A J., Chiu A C., Hsu P D., Dadon D B., Cheng A W., Trevino A E., Konermann S., Chen S., Jaenisch R., Zhang F., Sharp P A. Nat Biotechnol. April 20. doi: 10.1038/nbt.2889 (2014);

CRISPR-Cas9 Knockin Mice for Genome Editing and Cancer Modeling. Platt R J, Chen S, Zhou Y, Yim M J, Swiech L, Kempton H R, Dahlman J E, Parnas O, Eisenhaure™, Jovanovic M, Graham D B, Jhunjhunwala S, Heidenreich M, Xavier R J, Langer R, Anderson D G, Hacohen N, Regev A, Feng G, Sharp P A, Zhang F. Cell 159(2): 440-455 DOI: 10.1016/j.cell.2014.09.014(2014);

Development and Applications of CRISPR-Cas9 for Genome Engineering, Hsu P D, Lander E S, Zhang F., Cell. June 5; 157(6):1262-78 (2014).

Genetic screens in human cells using the CRISPR-Cas9 system, Wang T, Wei J J, Sabatini D M, Lander E S., Science. January 3; 343(6166): 80-84. doi:10.1126/science.1246981 (2014);

Rational design of highly active sgRNAs for CRISPR-Cas9-mediated gene inactivation, Doench J G, Hartenian E, Graham D B, Tothova Z, Hegde M, Smith I, Sullender M, Ebert B L, Xavier R J, Root D E., (published online 3 Sep. 2014) Nat Biotechnol. December; 32(12):1262-7 (2014);

In vivo interrogation of gene function in the mammalian brain using CRISPR-Cas9, Swiech L, Heidenreich M, Banerjee A, Habib N, Li Y, Trombetta J, Sur M, Zhang F., (published online 19 Oct. 2014) Nat Biotechnol. January; 33(1):102-6 (2015);

Genome-scale transcriptional activation by an engineered CRISPR-Cas9 complex, Konermann S, Brigham M D, Trevino A E, Joung J, Abudayyeh 00, Barcena C, Hsu P D, Habib N, Gootenberg J S, Nishimasu H, Nureki O, Zhang F., Nature. January 29; 517(7536):583-8 (2015).

A split-Cas9 architecture for inducible genome editing and transcription modulation, Zetsche B, Volz S E, Zhang F., (published online 2 Feb. 2015) Nat Biotechnol. February; 33(2):139-42 (2015);

Genome-wide CRISPR Screen in a Mouse Model of Tumor Growth and Metastasis, Chen S, Sanjana N E, Zheng K, Shalem O, Lee K, Shi X, Scott D A, Song J, Pan J Q, Weissleder R, Lee H, Zhang F, Sharp P A. Cell 160, 1246-1260, Mar. 12, 2015 (multiplex screen in mouse), and In vivo genome editing using *Staphylococcus aureus* Cas9, Ran F A, Cong L, Yan W X, Scott D A, Gootenberg J S, Kriz A J, Zetsche B, Shalem O, Wu X, Makarova K S, Koonin E V, Sharp P A, Zhang F., (published online 1 Apr. 2015), Nature. April 9; 520(7546):186-91 (2015).

Shalem et al., "High-throughput functional genomics using CRISPR-Cas9," Nature Reviews Genetics 16, 299-311 (May 2015).

Xu et al., "Sequence determinants of improved CRISPR sgRNA design," Genome Research 25, 1147-1157 (August 2015).

Parnas et al., "A Genome-wide CRISPR Screen in Primary Immune Cells to Dissect Regulatory Networks," Cell 162, 675-686 (Jul. 30, 2015).

Ramanan et al., CRISPR-Cas9 cleavage of viral DNA efficiently suppresses hepatitis B virus," Scientific Reports 5:10833. doi: 10.1038/srep10833 (Jun. 2, 2015)

Nishimasu et al., Crystal Structure of *Staphylococcus aureus* Cas9," Cell 162, 1113-1126 (Aug. 27, 2015)

BCL11A enhancer dissection by Cas9-mediated in situ saturating mutagenesis, Canver et al., Nature 527(7577): 192-7 (Nov. 12, 2015) doi: 10.1038/nature15521. Epub 2015 Sep. 16.

*Cas13 Is a Single RNA-Guided Endonuclease of a Class 2 CRISPR-Cas System*, Zetsche et al., Cell 163, 759-71 (Sep. 25, 2015).

*Discovery and Functional Characterization of Diverse Class 2 CRISPR-Cas Systems*, Shmakov et al., Molecular Cell, 60(3), 385-397 doi: 10.1016/j.molcel.2015.10.008 Epub Oct. 22, 2015.

*Rationally engineered Cas9 nucleases with improved specificity*, Slaymaker et al., Science 2016 Jan. 1 351(6268): 84-88 doi: 10.1126/science.aad5227. Epub 2015 Dec. 1.

Gao et al, "Engineered Cas13 Enzymes with Altered PAM Specificities," bioRxiv 091611; doi: dx.doi.org/10.1101/091611 (Dec. 4, 2016).

each of which is incorporated herein by reference, may be considered in the practice of the instant invention, and discussed briefly below:

Cong et al. engineered type II CRISPR-Cas systems for use in eukaryotic cells based on both *Streptococcus thermophilus* Cas9 and also *Streptococcus pyogenes* Cas9 and demonstrated that Cas9 nucleases can be directed by short RNAs to induce precise cleavage of DNA in human and mouse cells. Their study further showed that Cas9 as converted into a nicking enzyme can be used to facilitate homology-directed repair in eukaryotic cells with minimal mutagenic activity. Additionally, their study demonstrated that multiple guide sequences can be encoded into a single CRISPR array to enable simultaneous editing of several at endogenous genomic loci sites within the mammalian genome, demonstrating easy programmability and wide applicability of the RNA-guided nuclease technology. This ability to use RNA to program sequence specific DNA cleavage in cells defined a new class of genome engineering tools. These studies further showed that other CRISPR loci are likely to be transplantable into mammalian cells and can also mediate mammalian genome cleavage. Importantly, it can be envisaged that several aspects of the CRISPR-Cas system can be further improved to increase its efficiency and versatility.

Jiang et al. used the clustered, regularly interspaced, short palindromic repeats (CRISPR)-associated Cas9 endonuclease complexed with dual-RNAs to introduce precise mutations in the genomes of *Streptococcus pneumoniae* and *Escherichia coli*. The approach relied on dual-RNA: Cas9-directed cleavage at the targeted genomic site to kill unmutated cells and circumvents the need for selectable markers or counter-selection systems. The study reported reprogramming dual-RNA:Cas9 specificity by changing the sequence of short CRISPR RNA (crRNA) to make single- and multinucleotide changes carried on editing templates. The study showed that simultaneous use of two crRNAs enabled multiplex mutagenesis. Furthermore, when the approach was used in combination with recombineering, in *S. pneumoniae*, nearly 100% of cells that were recovered using the described approach contained the desired mutation, and in *E. coli*, 65% that were recovered contained the mutation.

Wang et al. (2013) used the CRISPR-Cas system for the one-step generation of mice carrying mutations in multiple genes which were traditionally generated in multiple steps by sequential recombination in embryonic stem cells and/or time-consuming intercrossing of mice with a single mutation. The CRISPR-Cas system will greatly accelerate the in vivo study of functionally redundant genes and of epistatic gene interactions.

Konermann et al. (2013) addressed the need in the art for versatile and robust technologies that enable optical and chemical modulation of DNA-binding domains based CRISPR Cas9 enzyme and also Transcriptional Activator Like Effectors Ran et al. (2013-A) described an approach that combined a Cas9 nickase mutant with paired guide RNAs to introduce targeted double-strand breaks. This addresses the issue of the Cas9 nuclease from the microbial CRISPR-Cas system being targeted to specific genomic loci by a guide sequence, which can tolerate certain mismatches to the DNA target and thereby promote undesired off-target mutagenesis. Because individual nicks in the genome are repaired with high fidelity, simultaneous nicking via appropriately offset guide RNAs is required for double-stranded breaks and extends the number of specifically recognized bases for target cleavage. The authors demonstrated that using paired nicking can reduce off-target activity by 50- to 1,500-fold in cell lines and to facilitate gene knockout in mouse zygotes without sacrificing on-target cleavage efficiency. This versatile strategy enables a wide variety of genome editing applications that require high specificity.

Hsu et al. (2013) characterized SpCas9 targeting specificity in human cells to inform the selection of target sites and avoid off-target effects. The study evaluated >700 guide RNA variants and SpCas9-induced indel mutation levels at >100 predicted genomic off-target loci in 293T and 293FT cells. The authors that SpCas9 tolerates mismatches between guide RNA and target DNA at different positions in a sequence-dependent manner, sensitive to the number, position and distribution of mismatches. The authors further showed that SpCas9-mediated cleavage is unaffected by DNA methylation and that the dosage of SpCas9 and guide RNA can be titrated to minimize off-target modification. Additionally, to facilitate mammalian genome engineering applications, the authors reported providing a web-based software tool to guide the selection and validation of target sequences as well as off-target analyses.

Ran et al. (2013-B) described a set of tools for Cas9-mediated genome editing via non-homologous end joining (NHEJ) or homology-directed repair (HDR) in mammalian cells, as well as generation of modified cell lines for downstream functional studies. To minimize off-target cleavage, the authors further described a double-nicking strategy using the Cas9 nickase mutant with paired guide RNAs. The protocol provided by the authors experimentally derived guidelines for the selection of target sites, evaluation of cleavage efficiency and analysis of off-target activity. The studies showed that beginning with target design, gene modifications can be achieved within as little as 1-2 weeks, and modified clonal cell lines can be derived within 2-3 weeks.

Shalem et al. described a new way to interrogate gene function on a genome-wide scale. Their studies showed that delivery of a genome-scale CRISPR-Cas9 knockout (GeCKO) library targeted 18,080 genes with 64,751 unique guide sequences enabled both negative and positive selection screening in human cells. First, the authors showed use of the GeCKO library to identify genes essential for cell viability in cancer and pluripotent stem cells. Next, in a melanoma model, the authors screened for genes whose loss is involved in resistance to vemurafenib, a therapeutic that inhibits mutant protein kinase BRAF. Their studies showed that the highest-ranking candidates included previously validated genes NF1 and MED12 as well as novel hits NF2, CUL3, TADA2B, and TADA1. The authors observed a high level of consistency between independent guide RNAs targeting the same gene and a high rate of hit confirmation, and thus demonstrated the promise of genome-scale screening with Cas9.

Nishimasu et al. reported the crystal structure of *Streptococcus pyogenes* Cas9 in complex with sgRNA and its target DNA at 2.5 A° resolution. The structure revealed a bilobed architecture composed of target recognition and nuclease lobes, accommodating the sgRNA:DNAn RNA duplex in a positively charged groove at their interface. Whereas the recognition lobe is essential for binding sgRNA and DNA, the nuclease lobe contains the HNH and RuvC nuclease domains, which are properly positioned for cleavage of the complementary and non-complementary strands of the target DNA, respectively. The nuclease lobe also contains a carboxyl-terminal domain responsible for the interaction with the protospacer adjacent motif (PAM). This high-resolution structure and accompanying functional analyses have revealed the molecular mechanism of RNA-guided DNA targeting by Cas9, thus paving the way for the rational design of new, versatile genome-editing technologies.

Wu et al. mapped genome-wide binding sites of a catalytically inactive Cas9 (dCas9) from *Streptococcus pyogenes* loaded with single guide RNAs (sgRNAs) in mouse embryonic stem cells (mESCs). The authors showed that each of the four sgRNAs tested targets dCas9 to between tens and thousands of genomic sites, frequently characterized by a 5-nucleotide seed region in the sgRNA and an NGG protospacer adjacent motif (PAM). Chromatin inaccessibility decreases dCas9 binding to other sites with matching seed sequences; thus 70% of off-target sites are associated with genes. The authors showed that targeted sequencing of 295 dCas9 binding sites in mESCs transfected with catalytically active Cas9 identified only one site mutated above background levels. The authors proposed a two-state model for Cas9 binding and cleavage, in which a seed match triggers binding but extensive pairing with target DNA is required for cleavage.

Platt et al. established a Cre-dependent Cas9 knockin mouse. The authors demonstrated in vivo as well as ex vivo genome editing using adeno-associated virus (AAV)-, lentivirus-, or particle-mediated delivery of guide RNA in neurons, immune cells, and endothelial cells.

Hsu et al. (2014) is a review article that discusses generally CRISPR-Cas9 history from yogurt to genome editing, including genetic screening of cells.

Wang et al. (2014) relates to a pooled, loss-of-function genetic screening approach suitable for both positive and negative selection that uses a genome-scale lentiviral single guide RNA (sgRNA) library.

Doench et al. created a pool of sgRNAs, tiling across all possible target sites of a panel of six endogenous mouse and three endogenous human genes and quantitatively assessed their ability to produce null alleles of their target gene by antibody staining and flow cytometry. The authors showed that optimization of the PAM improved activity and also provided an on-line tool for designing sgRNAs.

Swiech et al. demonstrate that AAV-mediated SpCas9 genome editing can enable reverse genetic studies of gene function in the brain.

Konermann et al. (2015) discusses the ability to attach multiple effector domains, e.g., transcriptional activator, functional and epigenomic regulators at appropriate positions on the guide such as stem or tetraloop with and without linkers.

Zetsche et al. demonstrates that the Cas9 enzyme can be split into two and hence the assembly of Cas9 for activation can be controlled.

Chen et al. relates to multiplex screening by demonstrating that a genome-wide in vivo CRISPR-Cas9 screen in mice reveals genes regulating lung metastasis.

Ran et al. (2015) relates to SaCas9 and its ability to edit genomes and demonstrates that one cannot extrapolate from biochemical assays.

Shalem et al. (2015) described ways in which catalytically inactive Cas9 (dCas9) fusions are used to synthetically repress (CRISPRi) or activate (CRISPRa) expression, showing. advances using Cas9 for genome-scale screens, including arrayed and pooled screens, knockout approaches that inactivate genomic loci and strategies that modulate transcriptional activity.

Xu et al. (2015) assessed the DNA sequence features that contribute to single guide RNA (sgRNA) efficiency in CRISPR-based screens. The authors explored efficiency of CRISPR-Cas9 knockout and nucleotide preference at the cleavage site. The authors also found that the sequence preference for CRISPRi/a is substantially different from that for CRISPR-Cas9 knockout.

Parnas et al. (2015) introduced genome-wide pooled CRISPR-Cas9 libraries into dendritic cells (DCs) to identify genes that control the induction of tumor necrosis factor (Tnf) by bacterial lipopolysaccharide (LPS).

Known regulators of Tlr4 signaling and previously unknown candidates were identified and classified into three functional modules with distinct effects on the canonical responses to LPS.

Ramanan et al (2015) demonstrated cleavage of viral episomal DNA (cccDNA) in infected cells. The HBV genome exists in the nuclei of infected hepatocytes as a 3.2 kb double-stranded episomal DNA species called covalently closed circular DNA (cccDNA), which is a key component in the HBV life cycle whose replication is not inhibited by current therapies. The authors showed that sgRNAs specifically targeting highly conserved regions of HBV robustly suppresses viral replication and depleted cccDNA.

Nishimasu et al. (2015) reported the crystal structures of SaCas9 in complex with a single guide RNA (sgRNA) and its double-stranded DNA targets, containing the 5'-TTGAAT-3' PAM and the 5'-TTGGGT-3' PAM. A structural comparison of SaCas9 with SpCas9 highlighted both structural conservation and divergence, explaining their distinct PAM specificities and orthologous sgRNA recognition.

Canver et al. (2015) demonstrated a CRISPR-Cas9-based functional investigation of non-coding genomic elements. The authors we developed pooled CRISPR-Cas9 guide RNA libraries to perform in situ saturating mutagenesis of the human and mouse BCL11A enhancers which revealed critical features of the enhancers.

Zetsche et al. (2015) reported characterization of Cas13, a class 2 CRISPR nuclease from *Francisella novicida* U112 having features distinct from Cas9. Cas13 is a single RNA-guided endonuclease lacking tracrRNA, utilizes a T-rich protospacer-adjacent motif, and cleaves DNA via a staggered DNA double-stranded break.

Shmakov et al. (2015) reported three distinct Class 2 CRISPR-Cas systems. Two system CRISPR enzymes (C2c1 and C2c3) contain RuvC-like endonuclease domains distantly related to Cas13. Unlike Cas13, C2c1 depends on both crRNA and tracrRNA for DNA cleavage. The third enzyme (C2c2) contains two predicted HEPN RNase domains and is tracrRNA independent.

Slaymaker et al (2016) reported the use of structure-guided protein engineering to improve the specificity of *Streptococcus pyogenes* Cas9 (SpCas9). The authors developed "enhanced specificity" SpCas9 (eSpCas9) variants which maintained robust on-target cleavage with reduced off-target effects.

The methods and tools provided herein are exemplified for Cas13, a type II nuclease that does not make use of tracrRNA. Orthologs of Cas13 have been identified in different bacterial species as described herein. Further type II nucleases with similar properties can be identified using methods described in the art (Shmakov et al. 2015, 60:385-397; Abudayeh et al. 2016, Science, 5; 353(6299)). In particular embodiments, such methods for identifying novel CRISPR effector proteins may comprise the steps of selecting sequences from the database encoding a seed which identifies the presence of a CRISPR Cas locus, identifying loci located within 10 kb of the seed comprising Open Reading Frames (ORFs) in the selected sequences, selecting therefrom loci comprising ORFs of which only a single ORF encodes a novel CRISPR effector having greater than 700 amino acids and no more than 90% homology to a known CRISPR effector. In particular embodiments, the seed is a protein that is common to the CRISPR-Cas system, such as Cas1. In further embodiments, the CRISPR array is used as a seed to identify new effector proteins.

The effectiveness of the present invention has been demonstrated. Preassembled recombinant CRISPR-Cas13 complexes comprising Cas13 and crRNA may be transfected, for example by electroporation, resulting in high mutation rates and absence of detectable off-target mutations. Hur, J. K. et al, Targeted mutagenesis in mice by electroporation of Cas13 ribonucleoproteins, Nat Biotechnol. 2016 Jun. 6. doi: 10.1038/nbt.3596. Genome-wide analyses shows that Cas13 is highly specific. By one measure, in vitro cleavage sites determined for Cas13 in human HEK293T cells were significantly fewer that for SpCas9. Kim, D. et al., Genome-wide analysis reveals specificities of Cas13 endonucleases in human cells, Nat Biotechnol. 2016 Jun. 6. doi: 10.1038/nbt.3609. An efficient multiplexed system employing Cas13 has been demonstrated in *Drosophila* employing gRNAs processed from an array containing inventing tRNAs. Port, F. et al, Expansion of the CRISPR toolbox in an animal with tRNA-flanked Cas9 and Cas13 gRNAs. doi: dx.doi.org/10.1101/046417.

Also, "Dimeric CRISPR RNA-guided FokI nucleases for highly specific genome editing", Shengdar Q. Tsai, Nicolas Wyvekens, Cyd Khayter, Jennifer A. Foden, Vishal Thapar, Deepak Reyon, Mathew J. Goodwin, Martin J. Aryee, J. Keith Joung Nature Biotechnology 32(6): 569-77 (2014), relates to dimeric RNA-guided FokI Nucleases that recognize extended sequences and can edit endogenous genes with high efficiencies in human cells.

With respect to general information on CRISPR/Cas Systems, components thereof, and delivery of such components, including methods, materials, delivery vehicles, vectors, particles, and making and using thereof, including as to amounts and formulations, as well as CRISPR-Cas-expressing eukaryotic cells, CRISPR-Cas expressing eukaryotes, such as a mouse, reference is made to: U.S. Pat. Nos. 8,999,641, 8,993,233, 8,697,359, 8,771,945, 8,795,965, 8,865,406, 8,871,445, 8,889,356, 8,889,418, 8,895,308, 8,906,616, 8,932,814, and 8,945,839; US Patent Publications US 2014-0310830 (U.S. application Ser. No. 14/105,031), US 2014-0287938 A1 (U.S. application Ser. No. 14/213,991), US 2014-0273234 A1 (U.S. application Ser. No. 14/293,674), US2014-0273232 A1 (U.S. application Ser. No. 14/290,575), US 2014-0273231 (U.S. application Ser. No. 14/259,420), US 2014-0256046 A1 (U.S. application Ser. No. 14/226,274), US 2014-0248702 A1 (U.S. application Ser. No. 14/258,458), US 2014-0242700 A1 (U.S. application Ser. No. 14/222,930), US 2014-0242699 A1 (U.S. application Ser. No. 14/183,512), US 2014-0242664 A1 (U.S. application Ser. No. 14/104,990), US 2014-0234972 A1 (U.S. application Ser. No. 14/183,471), US 2014-0227787 A1 (U.S. application Ser. No. 14/256,912), US 2014-0189896 A1 (U.S. application Ser. No. 14/105,035), US 2014-0186958 (U.S. application Ser. No. 14/105,017), US 2014-0186919 A1 (U.S. application Ser. No. 14/104,977), US 2014-0186843 A1 (U.S. application Ser. No. 14/104,900), US 2014-0179770 A1 (U.S. application Ser. No. 14/104,837) and US 2014-0179006 A1 (U.S. application Ser. No. 14/183,486), US 2014-0170753 (U.S. application Ser. No. 14/183,429); US 2015-0184139 (U.S. application Ser. No. 14/324,960); U.S. Ser. No. 14/054,414 European Patent Applications EP 2 771 468 (EP13818570.7), EP 2 764 103 (EP13824232.6), and EP 2 784 162 (EP14170383.5); and PCT Patent Publications WO2014/093661 (PCT/US2013/074743), WO2014/093694 (PCT/US2013/074790), WO2014/093595 (PCT/US2013/074611), WO2014/093718 (PCT/US2013/074825), WO2014/093709 (PCT/US2013/074812), WO2014/093622 (PCT/US2013/074667), WO2014/093635 (PCT/US2013/

074691), WO2014/093655 (PCT/US2013/074736), WO2014/093712 (PCT/US2013/074819), WO2014/093701 (PCT/US2013/074800), WO2014/018423 (PCT/US2014/051418), WO2014/204723 (PCT/US2014/041790), WO2014/204724 (PCT/US2014/041800), WO2014/204725 (PCT/US2014/041803), WO2014/204726 (PCT/US2014/041804), WO2014/204727 (PCT/US2014/041806), WO2014/204728 (PCT/US2014/041808), WO2014/204729 (PCT/US2014/041809), WO2015/089351 (PCT/US2014/069897), WO2015/089354 (PCT/US2014/069902), WO2015/089364 (PCT/US2014/069925), WO2015/089427 (PCT/US2014/070068), WO2015/089462 (PCT/US2014/070127), WO2015/089419 (PCT/US2014/070057), WO2015/089465 (PCT/US2014/070135), WO2015/089486 (PCT/US2014/070175), WO2015/058052 (PCT/US2014/061077), WO2015/070083 (PCT/US2014/064663), WO2015/089354 (PCT/US2014/069902), WO2015/089351 (PCT/US2014/069897), WO2015/089364 (PCT/US2014/069925), WO2015/089427 (PCT/US2014/070068), WO2015/089473 (PCT/US2014/070152), WO2015/089486 (PCT/US2014/070175), WO2016/049258 (PCT/US2015/051830), WO2016/094867 (PCT/US2015/065385), WO2016/094872 (PCT/US2015/065393), WO2016/094874 (PCT/US2015/065396), WO2016/106244 (PCT/US2015/067177).

Mention is also made of U.S. application 62/180,709, 17 June 15, PROTECTED GUIDE RNAS (PGRNAS); U.S. application 62/091,455, filed, 12 Dec. 14, PROTECTED GUIDE RNAS (PGRNAS); U.S. application 62/096,708, 24 Dec. 14, PROTECTED GUIDE RNAS (PGRNAS); U.S. applications 62/091,462, 12 Dec. 14, 62/096,324, 23 Dec. 14, 62/180,681, 17 Jun. 2015, and 62/237,496, 5 Oct. 2015, DEAD GUIDES FOR CRISPR TRANSCRIPTION FACTORS; U.S. application 62/091,456, 12 Dec. 14 and 62/180,692, 17 Jun. 2015, ESCORTED AND FUNCTIONALIZED GUIDES FOR CRISPR-CAS SYSTEMS; U.S. application 62/091,461, 12 Dec. 14, DELIVERY, USE AND THERAPEUTIC APPLICATIONS OF THE CRISPR-CAS SYSTEMS AND COMPOSITIONS FOR GENOME EDITING AS TO HEMATOPOIETIC STEM CELLS (HSCs); U.S. application 62/094,903, 19 Dec. 14, UNBIASED IDENTIFICATION OF DOUBLE-STRAND BREAKS AND GENOMIC REARRANGEMENT BY GENOME-WISE INSERT CAPTURE SEQUENCING; U.S. application 62/096,761, 24 Dec. 14, ENGINEERING OF SYSTEMS, METHODS AND OPTIMIZED ENZYME AND GUIDE SCAFFOLDS FOR SEQUENCE MANIPULATION; U.S. application 62/098,059, 30 Dec. 14, 62/181,641, 18 Jun. 2015, and 62/181,667, 18 Jun. 2015, RNA-TARGETING SYSTEM; U.S. application 62/096,656, 24 Dec. 14 and 62/181,151, 17 Jun. 2015, CRISPR HAVING OR ASSOCIATED WITH DESTABILIZATION DOMAINS; U.S. application 62/096,697, 24 Dec. 14, CRISPR HAVING OR ASSOCIATED WITH AAV; U.S. application 62/098,158, 30 Dec. 14, ENGINEERED CRISPR COMPLEX INSERTIONAL TARGETING SYSTEMS; U.S. application 62/151,052, 22 Apr. 15, CELLULAR TARGETING FOR EXTRACELLULAR EXOSOMAL REPORTING; U.S. application 62/054,490, 24 Sep. 14, DELIVERY, USE AND THERAPEUTIC APPLICATIONS OF THE CRISPR-CAS SYSTEMS AND COMPOSITIONS FOR TARGETING DISORDERS AND DISEASES USING PARTICLE DELIVERY COMPONENTS; U.S. application 61/939,154, 12 Feb. 14, SYSTEMS, METHODS AND COMPOSITIONS FOR SEQUENCE MANIPULATION WITH OPTIMIZED FUNCTIONAL CRISPR-CAS SYSTEMS; U.S. application 62/055,484, 25 Sep. 14, SYSTEMS, METHODS AND COMPOSITIONS FOR SEQUENCE MANIPULATION WITH OPTIMIZED FUNCTIONAL CRISPR-CAS SYSTEMS; U.S. application 62/087,537, 4 Dec. 14, SYSTEMS, METHODS AND COMPOSITIONS FOR SEQUENCE MANIPULATION WITH OPTIMIZED FUNCTIONAL CRISPR-CAS SYSTEMS; U.S. application 62/054,651, 24 Sep. 14, DELIVERY, USE AND THERAPEUTIC APPLICATIONS OF THE CRISPR-CAS SYSTEMS AND COMPOSITIONS FOR MODELING COMPETITION OF MULTIPLE CANCER MUTATIONS IN VIVO; U.S. application 62/067,886, 23 Oct. 14, DELIVERY, USE AND THERAPEUTIC APPLICATIONS OF THE CRISPR-CAS SYSTEMS AND COMPOSITIONS FOR MODELING COMPETITION OF MULTIPLE CANCER MUTATIONS IN VIVO; U.S. applications 62/054,675, 24 Sep. 14 and 62/181,002, 17 Jun. 2015, DELIVERY, USE AND THERAPEUTIC APPLICATIONS OF THE CRISPR-CAS SYSTEMS AND COMPOSITIONS IN NEURONAL CELLS/TISSUES; U.S. application 62/054,528, 24 Sep. 14, DELIVERY, USE AND THERAPEUTIC APPLICATIONS OF THE CRISPR-CAS SYSTEMS AND COMPOSITIONS IN IMMUNE DISEASES OR DISORDERS; U.S. application 62/055,454, 25 Sep. 14, DELIVERY, USE AND THERAPEUTIC APPLICATIONS OF THE CRISPR-CAS SYSTEMS AND COMPOSITIONS FOR TARGETING DISORDERS AND DISEASES USING CELL PENETRATION PEPTIDES (CPP); U.S. application 62/055,460, 25 Sep. 14, MULTIFUNCTIONAL-CRISPR COMPLEXES AND/OR OPTIMIZED ENZYME LINKED FUNCTIONAL-CRISPR COMPLEXES; U.S. application 62/087,475, 4 Dec. 14 and 62/181,690, 18 Jun. 2015, FUNCTIONAL SCREENING WITH OPTIMIZED FUNCTIONAL CRISPR-CAS SYSTEMS; U.S. application 62/055,487, 25 Sep. 14, FUNCTIONAL SCREENING WITH OPTIMIZED FUNCTIONAL CRISPR-CAS SYSTEMS; U.S. application 62/087,546, 4 Dec. 14 and 62/181,687, 18 Jun. 2015, MULTIFUNCTIONAL CRISPR COMPLEXES AND/OR OPTIMIZED ENZYME LINKED FUNCTIONAL-CRISPR COMPLEXES; and U.S. application 62/098,285, 30 Dec. 14, CRISPR MEDIATED IN VIVO MODELING AND GENETIC SCREENING OF TUMOR GROWTH AND METASTASIS.

Mention is made of U.S. applications 62/181,659, 18 Jun. 2015 and 62/207,318, 19 Aug. 2015, ENGINEERING AND OPTIMIZATION OF SYSTEMS, METHODS, ENZYME AND GUIDE SCAFFOLDS OF CAS9 ORTHOLOGS AND VARIANTS FOR SEQUENCE MANIPULATION. Mention is made of U.S. applications 62/181,663, 18 Jun. 2015 and 62/245,264, 22 Oct. 2015, NOVEL CRISPR ENZYMES AND SYSTEMS, U.S. applications 62/181,675, 18 Jun. 2015, 62/285,349, 22 Oct. 2015, 62/296,522, 17 Feb. 2016, and 62/320,231, 8 Apr. 2016, NOVEL CRISPR ENZYMES AND SYSTEMS, U.S. application 62/232,067, 24 Sep. 2015, U.S. application Ser. No. 14/975,085, 18 Dec. 2015, European application No. 16150428.7, U.S. application 62/205,733, 16 Aug. 2015, U.S. application 62/201,542, 5 Aug. 2015, U.S. application 62/193,507, 16 Jul. 2015, and U.S. application 62/181,739, 18 Jun. 2015, each entitled NOVEL CRISPR ENZYMES AND SYSTEMS and of U.S. application 62/245,270, 22 Oct. 2015, NOVEL CRISPR ENZYMES AND SYSTEMS. Mention is also made of U.S. application 61/939,256, 12 Feb. 2014, and WO 2015/089473 (PCT/US2014/070152), 12 Dec. 2014, each entitled ENGINEERING OF SYSTEMS, METHODS AND OPTIMIZED GUIDE COMPOSITIONS WITH NEW ARCHITECTURES FOR SEQUENCE MANIPULATION. Mention is also made of PCT/US2015/045504, 15 Aug. 2015, U.S.

application 62/180,699, 17 Jun. 2015, and U.S. application 62/038,358, 17 Aug. 2014, each entitled GENOME EDITING USING CAS9 NICKASES.

Each of these patents, patent publications, and applications, and all documents cited therein or during their prosecution ("appln cited documents") and all documents cited or referenced in the appln cited documents, together with any instructions, descriptions, product specifications, and product sheets for any products mentioned therein or in any document therein and incorporated by reference herein, are hereby incorporated herein by reference, and may be employed in the practice of the invention. All documents (e.g., these patents, patent publications and applications and the appln cited documents) are incorporated herein by reference to the same extent as if each individual document was specifically and individually indicated to be incorporated by reference.

Type-V CRISPR-Cas Protein

The application describes methods using Type-V CRISPR-Cas proteins. This is exemplified herein with Cas13, whereby a number of orthologs or homologs have been identified. It will be apparent to the skilled person that further orthologs or homologs can be identified and that any of the functionalities described herein may be engineered into other orthologs, including chimeric enzymes comprising fragments from multiple orthologs.

Computational methods of identifying novel CRISPR-Cas loci are described in EP3009511 or US2016208243 and may comprise the following steps: detecting all contigs encoding the Cas1 protein; identifying all predicted protein coding genes within 20 kB of the cas1 gene; comparing the identified genes with Cas protein-specific profiles and predicting CRISPR arrays; selecting unclassified candidate CRISPR-Cas loci containing proteins larger than 500 amino acids (>500 aa); analyzing selected candidates using methods such as PSI-BLAST and HHPred to screen for known protein domains, thereby identifying novel Class 2 CRISPR-Cas loci (see also Schmakov et al. 2015, Mol Cell. 60(3): 385-97). In addition to the above mentioned steps, additional analysis of the candidates may be conducted by searching metagenomics databases for additional homologs. Additionally or alternatively, to expand the search to non-autonomous CRISPR-Cas systems, the same procedure can be performed with the CRISPR array used as the seed.

In one aspect the detecting all contigs encoding the Cas1 protein is performed by GenemarkS which a gene prediction program as further described in "GeneMarkS: a self-training method for prediction of gene starts in microbial genomes. Implications for finding sequence motifs in regulatory regions." John Besemer, Alexandre Lomsadze and Mark Borodovsky, Nucleic Acids Research (2001) 29, pp 2607-2618, herein incorporated by reference.

In one aspect the identifying all predicted protein coding genes is carried out by comparing the identified genes with Cas protein-specific profiles and annotating them according to NCBI Conserved Domain Database (CDD) which is a protein annotation resource that consists of a collection of well-annotated multiple sequence alignment models for ancient domains and full-length proteins. These are available as position-specific score matrices (PSSMs) for fast identification of conserved domains in protein sequences via RPS-BLAST. CDD content includes NCBI-curated domains, which use 3D-structure information to explicitly define domain boundaries and provide insights into sequence/structure/function relationships, as well as domain models imported from a number of external source databases (Pfam, SMART, COG, PRK, TIGRFAM). In a further aspect, CRISPR arrays were predicted using a PILER-CR program which is a public domain software for finding CRISPR repeats as described in "PILER-CR: fast and accurate identification of CRISPR repeats", Edgar, R. C., BMC Bioinformatics, January 20; 8:18(2007), herein incorporated by reference.

In a further aspect, the case by case analysis is performed using PSI-BLAST (Position-Specific Iterative Basic Local Alignment Search Tool). PSI-BLAST derives a position-specific scoring matrix (PSSM) or profile from the multiple sequence alignment of sequences detected above a given score threshold using protein-protein BLAST. This PSSM is used to further search the database for new matches, and is updated for subsequent iterations with these newly detected sequences. Thus, PSI-BLAST provides a means of detecting distant relationships between proteins.

In another aspect, the case by case analysis is performed using HHpred, a method for sequence database searching and structure prediction that is as easy to use as BLAST or PSI-BLAST and that is at the same time much more sensitive in finding remote homologs. In fact, HHpred's sensitivity is competitive with the most powerful servers for structure prediction currently available. HHpred is the first server that is based on the pairwise comparison of profile hidden Markov models (HMMs). Whereas most conventional sequence search methods search sequence databases such as UniProt or the NR, HHpred searches alignment databases, like Pfam or SMART. This greatly simplifies the list of hits to a number of sequence families instead of a clutter of single sequences. All major publicly available profile and alignment databases are available through HHpred. HHpred accepts a single query sequence or a multiple alignment as input. Within only a few minutes it returns the search results in an easy-to-read format similar to that of PSI-BLAST. Search options include local or global alignment and scoring secondary structure similarity. HHpred can produce pairwise query-template sequence alignments, merged query-template multiple alignments (e.g. for transitive searches), as well as 3D structural models calculated by the MODELLER software from HHpred alignments.

Orthologs of Cas13

The terms "orthologue" (also referred to as "ortholog" herein) and "homologue" (also referred to as "homolog" herein) are well known in the art. By means of further guidance, a "homologue" of a protein as used herein is a protein of the same species which performs the same or a similar function as the protein it is a homologue of Homologous proteins may but need not be structurally related, or are only partially structurally related. An "orthologue" of a protein as used herein is a protein of a different species which performs the same or a similar function as the protein it is an orthologue of Orthologous proteins may but need not be structurally related, or are only partially structurally related. Homologs and orthologs may be identified by homology modelling (see, e.g., Greer, Science vol. 228 (1985) 1055, and Blundell et al. Eur J Biochem vol 172 (1988), 513) or "structural BLAST" (Dey F, Cliff Zhang Q, Petrey D, Honig B. Toward a "structural BLAST": using structural relationships to infer function. Protein Sci. 2013 April; 22(4):359-66. doi: 10.1002/pro.2225.). See also Shmakov et al. (2015) for application in the field of CRISPR-Cas loci. Homologous proteins may but need not be structurally related, or are only partially structurally related.

The Cas13 gene is found in several diverse bacterial genomes, typically in the same locus with cas1, cas2, and cas4 genes and a CRISPR cassette (for example, FNFX1_1431-FNFX1_1428 of *Francisella* cf. *novicida* Fx1). Thus, the layout of this putative novel CRISPR-Cas system appears to be similar to that of type II-B. Furthermore, similar to Cas9, the Cas13 protein contains a readily identifiable C-terminal region that is homologous to the transposon ORF-B and includes an active RuvC-like nuclease, an arginine-rich region, and a Zn finger (absent in Cas9). However, unlike Cas9, Cas13 is also present in several genomes without a CRISPR-Cas context and its relatively high similarity with ORF-B suggests that it might be a transposon component. It was suggested that if this was a genuine CRISPR-Cas system and Cas13 is a functional analog of Cas9 it would be a novel CRISPR-Cas type, namely type V (See Annotation and Classification of CRISPR-Cas Systems. Makarova K S, Koonin E V. Methods Mol Biol. 2015; 1311:47-75). However, as described herein, Cas13 is denoted to be in subtype V-A to distinguish it from C2c1p which does not have an identical domain structure and is hence denoted to be in subtype V-B.

The present invention encompasses the use of a Cas13 effector protein, derived from a Cas13 locus denoted as subtype V-A. Herein such effector proteins are also referred to as "Cas13p", e.g., a Cas13 protein (and such effector protein or Cas13 protein or protein derived from a Cas13 locus is also called "CRISPR-Cas protein").

In particular embodiments, the effector protein is a Cas13 effector protein from an organism from a genus comprising *Streptococcus, Campylobacter, Nitratifractor, Staphylococcus, Parvibaculum, Roseburia, Neisseria, Gluconacetobacter, Azospirillum, Sphaerochaeta, Lactobacillus, Eubacterium, Corynebacter, Carnobacterium, Rhodobacter, Listeria, Paludibacter, Clostridium,* Lachnospiraceae, *Clostridiaridium, Leptotrichia, Francisella, Legionella, Alicyclobacillus, Methanomethylophilus, Porphyromonas, Prevotella, Bacteroidetes, Helcococcus, Leptospira, Desulfovibrio, Desulfonatronum, Opitutaceae, Tuberibacillus, Bacillus, Brevibacillus, Methylobacterium, Butyrivibrio, Perigrinibacterium, Parcubacterium, Moraxella, Thiomicrospira* or *Acidaminococcus*. In particular embodiments, the Cas13 effector protein is selected from an organism from a genus selected from *Eubacterium,* Lachnospiraceae, *Leptotrichia, Francisella, Methanomethylophilus, Porphyromonas, Prevotella, Leptospira, Butyrivibrio, Perigrinibacterium, Parcubacterium, Moraxella, Thiomicrospira* or *Acidaminococcus*

In further particular embodiments, the Cas13 effector protein is from an organism selected from *S. mutans, S. agalactiae, S. equisimilis, S. sanguinis, S. pneumonia; C. jejuni, C. coli; N. salsuginis, N. tergarcus; S. auricularis, S. carnosus; N. meningitides, N. gonorrhoeae; L. monocytogenes, L. ivanovii; C. botulinum, C. difficile, C. tetani, C. sordellii, L. inadai, F. tularensis* 1, *P. albensis, L. bacterium, B. proteoclasticus, P. bacterium, P. crevioricanis, P. disiens* and *P. macacae*.

The effector protein may comprise a chimeric effector protein comprising a first fragment from a first effector protein (e.g., a Cas13) ortholog and a second fragment from a second effector (e.g., a Cas13) protein ortholog, and wherein the first and second effector protein orthologs are different. At least one of the first and second effector protein (e.g., a Cas13) orthologs may comprise an effector protein (e.g., a Cas13) from an organism comprising *Streptococcus, Campylobacter, Nitratifractor, Staphylococcus, Parvibaculum, Roseburia, Neisseria, Gluconacetobacter, Azospirillum, Sphaerochaeta, Lactobacillus, Eubacterium, Corynebacter, Carnobacterium, Rhodobacter, Listeria, Paludibacter, Clostridium,* Lachnospiraceae, *Clostridiaridium, Leptotrichia, Francisella, Legionella, Alicyclobacillus, Methanomethylophilus, Porphyromonas, Prevotella, Bacteroidetes, Helcococcus, Leptospira, Desulfovibrio, Desulfonatronum, Opitutaceae, Tuberibacillus, Bacillus, Brevibacillus, Methylobacterium, Butyrivibrio, Perigrinibacterium, Parcubacterium, Moraxella, Thiomicrospira* or *Acidaminococcus*; e.g., a chimeric effector protein comprising a first fragment and a second fragment wherein each of the first and second fragments is selected from a Cas13 of an organism comprising *Streptococcus, Campylobacter, Nitratifractor, Staphylococcus, Parvibaculum, Roseburia, Neisseria, Gluconacetobacter, Azospirillum, Sphaerochaeta, Lactobacillus, Eubacterium, Corynebacter, Carnobacterium, Rhodobacter, Listeria, Paludibacter, Clostridium,* Lachnospiraceae, *Clostridiaridium, Leptotrichia, Francisella, Legionella, Alicyclobacillus, Methanomethylophilus, Porphyromonas, Prevotella, Bacteroidetes, Helcococcus, Leptospira, Desulfovibrio, Desulfonatronum, Opitutaceae, Tuberibacillus, Bacillus, Brevibacillus, Methylobacterium, Butyrivibrio, Perigrinibacterium, Parcubacterium, Moraxella, Thiomicrospira* or *Acidaminococcus* wherein the first and second fragments are not from the same bacteria; for instance a chimeric effector protein comprising a first fragment and a second fragment wherein each of the first and second fragments is selected from a Cas13 of *S. mutans, S. agalactiae, S. equisimilis, S. sanguinis, S. pneumonia; C. jejuni, C. coli; N. salsuginis, N. tergarcus; S. auricularis, S. carnosus; N. meningitides, N. gonorrhoeae; L. monocytogenes, L. ivanovii; C. botulinum, C. difficile, C. tetani, C. sordellii; Francisella tularensis* 1, *Prevotella albensis,* Lachnospiraceae bacterium MC2017 1, *Butyrivibrio proteoclasticus,* Peregrinibacteria bacterium GW2011_GWA2_33_10, Parcubacteria bacterium GW2011_GWC2_44_17, *Smithella* sp. SCADC, *Acidaminococcus* sp. BV3L6, Lachnospiraceae bacterium MA2020, *Candidatus Methanoplasma termitum, Eubacterium eligens, Moraxella bovoculi* 237, *Leptospira inadai,* Lachnospiraceae bacterium ND2006, *Porphyromonas crevioricanis* 3, *Prevotella disiens* and *Porphyromonas macacae,* wherein the first and second fragments are not from the same bacteria.

In a more preferred embodiment, the Cas13p is derived from a bacterial species selected from *Francisella tularensis* 1, *Prevotella albensis,* Lachnospiraceae bacterium MC2017 1, *Butyrivibrio proteoclasticus,* Peregrinibacteria bacterium GW2011_GWA2_33_10, Parcubacteria bacterium GW2011_GWC2_44_17, *Smithella* sp. SCADC, *Acidaminococcus* sp. BV3L6, Lachnospiraceae bacterium MA2020, *Candidatus Methanoplasma termitum, Eubacterium eligens, Moraxella bovoculi* 237, *Moraxella bovoculi* AAX08_00205, *Moraxella bovoculi* AAX11_00205, *Butyrivibrio* sp. NC3005, *Thiomicrospira* sp. XS5, *Leptospira inadai,* Lachnospiraceae bacterium ND2006, *Porphyromonas crevioricanis* 3, *Prevotella disiens* and *Porphyromonas macacae*. In certain embodiments, the Cas13p is derived from a bacterial species selected from *Acidaminococcus* sp. BV3L6, Lachnospiraceae bacterium MA2020. In certain embodiments, the effector protein is derived from a subspecies of *Francisella tularensis* 1, including but not limited to *Francisella tularensis* subsp. *Novicida*. In certain preferred embodiments, the Cas13p is derived from a bacterial species selected from *Acidaminococcus* sp. BV3L6, Lachnospiraceae bacterium ND2006, Lachnospiraceae bacterium MA2020, *Moraxella bovoculi* AAX08_00205, *Moraxella bovoculi* AAX11_00205, *Butyrivibrio* sp. NC3005, or *Thiomicrospira* sp. XS5.

In particular embodiments, the homologue or orthologue of Cas13 as referred to herein has a sequence homology or identity of at least 80%, more preferably at least 85%, even more preferably at least 90%, such as for instance at least 95% with the example Cas13 proteins disclosed herein. In further embodiments, the homologue or orthologue of Cas13 as referred to herein has a sequence identity of at least 80%, more preferably at least 85%, even more preferably at least 90%, such as for instance at least 95% with the wild type Cas13. Where the Cas13 has one or more mutations (mutated), the homologue or orthologue of said Cas13 as referred to herein has a sequence identity of at least 80%, more preferably at least 85%, even more preferably at least 90%, such as for instance at least 95% with the mutated Cas13.

In an embodiment, the Cas13 protein may be an ortholog of an organism of a genus which includes, but is not limited to *Acidaminococcus* sp, Lachnospiraceae bacterium or *Moraxella bovoculi*; in particular embodiments, the type V Cas protein may be an ortholog of an organism of a species which includes, but is not limited to *Acidaminococcus* sp. BV3L6; Lachnospiraceae bacterium ND2006 (LbCas13) or *Moraxella bovoculi* 237. In particular embodiments, the homologue or orthologue of Cas13 as referred to herein has a sequence homology or identity of at least 80%, more preferably at least 85%, even more preferably at least 90%, such as for instance at least 95% with one or more of the Cas13 sequences disclosed herein. In further embodiments, the homologue or orthologue of Cas13 as referred to herein has a sequence identity of at least 80%, more preferably at least 85%, even more preferably at least 90%, such as for instance at least 95% with the wild type FnCas13, AsCas13 or LbCas13.

In particular embodiments, the Cas13 protein of the invention has a sequence homology or identity of at least 60%, more particularly at least 70, such as at least 80%, more preferably at least 85%, even more preferably at least 90%, such as for instance at least 95% with FnCas13, AsCas13 or LbCas13. In further embodiments, the Cas13 protein as referred to herein has a sequence identity of at least 60%, such as at least 70%, more particularly at least 80%, more preferably at least 85%, even more preferably at least 90%, such as for instance at least 95% with the wild type AsCas13 or LbCas13. In particular embodiments, the Cas13 protein of the present invention has less than 60% sequence identity with FnCas13. The skilled person will understand that this includes truncated forms of the Cas13 protein whereby the sequence identity is determined over the length of the truncated form. In particular embodiments, the Cas13 enzyme is not FnCas13.

Modified Cas13 Enzymes

In particular embodiments, it is of interest to make use of an engineered Cas13 protein as defined herein, such as Cas13, wherein the protein complexes with a nucleic acid molecule comprising RNA to form a CRISPR complex, wherein when in the CRISPR complex, the nucleic acid molecule targets one or more target polynucleotide loci, the protein comprises at least one modification compared to unmodified Cas13 protein, and wherein the CRISPR complex comprising the modified protein has altered activity as compared to the complex comprising the unmodified Cas13 protein. It is to be understood that when referring herein to CRISPR "protein", the Cas13 protein preferably is a modified CRISPR-Cas protein (e.g. having increased or decreased (or no) enzymatic activity, such as without limitation including Cas13. The term "CRISPR protein" may be used interchangeably with "CRISPR-Cas protein", irrespective of whether the CRISPR protein has altered, such as increased or decreased (or no) enzymatic activity, compared to the wild type CRISPR protein.

Computational analysis of the primary structure of Cas13 nucleases reveals three distinct regions. First a C-terminal RuvC like domain, which is the only functional characterized domain. Second a N-terminal alpha-helical region and thirst a mixed alpha and beta region, located between the RuvC like domain and the alpha-helical region.

Several small stretches of unstructured regions are predicted within the Cas13 primary structure. Unstructured regions, which are exposed to the solvent and not conserved within different Cas13 orthologs, are preferred sides for splits and insertions of small protein sequences. In addition, these sides can be used to generate chimeric proteins between Cas13 orthologs.

Based on the above information, mutants can be generated which lead to inactivation of the enzyme or which modify the double strand nuclease to nickase activity. In alternative embodiments, this information is used to develop enzymes with reduced off-target effects (described elsewhere herein)

In certain of the above-described Cas13 enzymes, the enzyme is modified by mutation of one or more residues (in the RuvC domain) including but not limited to positions R909, R912, R930, R947, K949, R951, R955, K965, K968, K1000, K1002, R1003, K1009, K1017, K1022, K1029, K1035, K1054, K1072, K1086, R1094, R1095, K1109, K1118, K1142, K1150, K1158, K1159, R1220, R1226, R1242, and/or R1252 with reference to amino acid position numbering of AsCas13 (*Acidaminococcus* sp. BV3L6). In certain embodiments, the Cas13 enzymes comprising said one or more mutations have modified, more preferably increased specificity for the target.

In certain of the above-described non-naturally-occurring CRISPR-Cas proteins, the enzyme is modified by mutation of one or more residues (in the RAD50) domain including but not limited positions K324, K335, K337, R331, K369, K370, R386, R392, R393, K400, K404, K406, K408, K414, K429, K436, K438, K459, K460, K464, R670, K675, R681, K686, K689, R699, K705, R725, K729, K739, K748, and/or K752 with reference to amino acid position numbering of AsCas13 (*Acidaminococcus* sp. BV3L6). In certain embodiments, the Cas13 enzymes comprising said one or more mutations have modified, more preferably increased specificity for the target.

In certain of the Cas13 enzymes, the enzyme is modified by mutation of one or more residues including but not limited positions R912, T923, R947, K949, R951, R955, K965, K968, K1000, R1003, K1009, K1017, K1022, K1029, K1072, K1086, F1103, R1226, and/or R1252 with reference to amino acid position numbering of AsCas13 (*Acidaminococcus* sp. BV3L6). In certain embodiments, the Cas13 enzymes comprising said one or more mutations have modified, more preferably increased specificity for the target.

In certain embodiments, the Cas13 enzyme is modified by mutation of one or more residues including but not limited positions R833, R836, K847, K879, K881, R883, R887, K897, K900, K932, R935, K940, K948, K953, K960, K984, K1003, K1017, R1033, R1138, R1165, and/or R1252 with reference to amino acid position numbering of LbCas13 (Lachnospiraceae bacterium ND2006). In certain embodiments, the Cas13 enzymes comprising said one or more mutations have modified, more preferably increased specificity for the target.

In certain embodiments, the Cas13 enzyme is modified by mutation of one or more residues including but not limited positions K15, R18, K26, Q34, R43, K48, K51, R56, R84, K85, K87, N93, R103, N104, T118, K123, K134, R176, K177, R192, K200, K226, K273, K275, T291, R301, K307, K369, 5404, V409, K414, K436, K438, K468, D482, K516, R518, K524, K530, K532, K548, K559, K570, R574, K592, D596, K603, K607, K613, C647, R681, K686, H720, K739, K748, K757, T766, K780, R790, P791, K796, K809, K815, T816, K860, R862, R863, K868, K897, R909, R912, T923, R947, K949, R951, R955, K965, K968, K1000, R1003, K1009, K1017, K1022, K1029, A1053, K1072, K1086, F1103, S1209, R1226, R1252, K1273, K1282, and/or K1288 with reference to amino acid position numbering of AsCas13 (*Acidaminococcus* sp. BV3L6). In certain embodiments, the Cas13 enzymes comprising said one or more mutations have modified, more preferably increased specificity for the target.

In certain embodiments, the enzyme is modified by mutation of one or more residues including but not limited positions K15, R18, K26, R34, R43, K48, K51, K56, K87, K88, D90, K96, K106, K107, K120, Q125, K143, R186, K187, R202, K210, K235, K296, K298, K314, K320, K326, K397, K444, K449, E454, A483, E491, K527, K541, K581, R583, K589, K595, K597, K613, K624, K635, K639, K656, K660, K667, K671, K677, K719, K725, K730, K763, K782, K791, R800, K809, K823, R833, K834, K839, K852, K858, K859, K869, K871, R872, K877, K905, R918, R921, K932, I960, K962, R964, R968, K978, K981, K1013, R1016, K1021, K1029, K1034, K1041, K1065, K1084, and/or K1098 with reference to amino acid position numbering of FnCas13 (*Francisella novicida* U112). In certain embodiments, the Cas13 enzymes comprising said one or more mutations have modified, more preferably increased specificity for the target.

In certain embodiments, the enzyme is modified by mutation of one or more residues including but not limited positions K15, R18, K26, R34, R43, K48, K51, R56, K83, K84, R86, K92, R102, K103, K116, K121, R158, E159, R174, R182, K206, K251, K253, K269, K271, K278, P342, K380, R385, K390, K415, K421, K457, K471, A506, R508, K514, K520, K522, K538, Y548, K560, K564, K580, K584, K591, K595, K601, K634, K640, R645, K679, K689, R707, T716, K725, R737, R747, K748, K753, K768, K774, K775, K785, K787, R788, Q793, K821, R833, R836, K847, K879, K881, K883, R887, K897, K900, K932, R935, K940, K948, K953, K960, K984, K1003, K1017, R1033, K1121, R1138, R1165, K1190, K1199, and/or K1208 with reference to amino acid position numbering of LbCas13 (Lachnospiraceae bacterium ND2006). In certain embodiments, the Cas13 enzymes comprising said one or more mutations have modified, more preferably increased specificity for the target.

In certain embodiments, the enzyme is modified by mutation of one or more residues including but not limited positions K14, R17, R25, K33, M42, Q47, K50, D55, K85, N86, K88, K94, R104, K105, K118, K123, K131, R174, K175, R190, R198, I221, K267, Q269, K285, K291, K297, K357, K403, K409, K414, K448, K460, K501, K515, K550, R552, K558, K564, K566, K582, K593, K604, K608, K623, K627, K633, K637, E643, K780, Y787, K792, K830, Q846, K858, K867, K876, K890, R900, K901, M906, K921, K927, K928, K937, K939, R940, K945, Q975, R987, R990, K1001, R1034, I1036, R1038, R1042, K1052, K1055, K1087, R1090, K1095, N1103, K1108, K1115, K1139, K1158, R1172, K1188, K1276, R1293, A1319, K1340, K1349, and/or K1356 with reference to amino acid position numbering of MbCas13 (*Moraxella bovoculi* 237). In certain embodiments, the Cas13 enzymes comprising said one or more mutations have modified, more preferably increased specificity for the target.

In one embodiment, the Cas13 protein is modified with a mutation at S1228 (e.g., S1228A) with reference to amino acid position numbering of AsCas13. See Yamano et al., Cell 165:949-962 (2016), which is incorporated herein by reference in its entirety.

In certain embodiments, the Cas13 protein has been modified to recognize a non-natural PAM, such as recognizing a PAM having a sequence or comprising a sequence YCN, YCV, AYV, TYV, RYN, RCN, TGYV, NTTN, TTN, TRTN, TYTV, TYCT, TYCN, TRTN, NTTN, TACT, TYCC, TRTC, TATV, NTTV, TTV, TSTG, TVTS, TYYS, TCYS, TBYS, TCYS, TNYS, TYYS, TNTN, TSTG, TTCC, TCCC, TATC, TGTG, TCTG, TYCV, or TCTC. In particular embodiments, said mutated Cas13 comprises one or more mutated amino acid residue at position 11, 12, 13, 14, 15, 16, 17, 34, 36, 39, 40, 43, 46, 47, 50, 54, 57, 58, 111, 126, 127, 128, 129, 130, 131, 132, 133, 134, 135, 136, 157, 158, 159, 160, 161, 162, 163, 164, 165, 166, 167, 168, 169, 170, 171, 172, 173, 174, 175, 176, 177, 178, 532, 533, 534, 535, 536, 537, 538, 539, 540, 541, 542, 543, 544, 545, 546, 547, 548, 549, 550, 551, 552, 553, 554, 555, 556, 565, 566, 567, 568, 569, 570, 571, 572, 573, 574, 575, 592, 593, 594, 595, 596, 597, 598, 599, 600, 601, 602, 603, 604, 605, 606, 607, 608, 609, 610, 611, 612, 613, 614, 615, 616, 617, 618, 619, 620, 626, 627, 628, 629, 630, 631, 632, 633, 634, 635, 636, 637, 638, 642, 643, 644, 645, 646, 647, 648, 649, 651, 652, 653, 654, 655, 656, 676, 679, 680, 682, 683, 684, 685, 686, 687, 688, 689, 690, 691, 692, 693, 707, 711, 714, 715, 716, 717, 718, 719, 720, 721, 722, 739, 765, 768, 769, 773, 777, 778, 779, 780, 781, 782, 783, 784, 785, 786, 871, 872, 873, 874, 875, 876, 877, 878, 879, 880, 881, 882, 883, 884, or 1048 of AsCas13 or a position corresponding thereto in a Cas13 ortholog; preferably, one or more mutated amino acid residue at position 130, 131, 132, 133, 134, 135, 136, 162, 163, 164, 165, 166, 167, 168, 169, 170, 171, 172, 173, 174, 175, 176, 177, 536, 537, 538, 539, 540, 541, 542, 543, 544, 545, 546, 547, 548, 549, 550, 551, 552, 570, 571, 572, 573, 595, 596, 597, 598, 599, 600, 601, 602, 603, 604, 605, 606, 607, 608, 609, 610, 611, 612, 613, 614, 615, 630, 631, 632, 646, 647, 648, 649, 650, 651, 652, 653, 683, 684, 685, 686, 687, 688, 689, or 690;

In certain embodiments, the Cas13 protein is modified to have increased activity, i.e. wider PAM specificity. In particular embodiments, the Cas13 protein is modified by mutation of one or more residues including but not limited positions 539, 542, 547, 548, 550, 551, 552, 167, 604, and/or 607 of AsCas13, or the corresponding position of an AsCas13 orthologue, homologue, or variant, preferably mutated amino acid residues at positions 542 or 542 and 607, wherein said mutations preferably are 542R and 607R, such as S542R and K607R; or preferably mutated amino acid residues at positions 542 and 548 (and optionally 552), wherein said mutations preferably are 542R and 548V (and optionally 552R), such as S542R and K548V (and optionally N552R); or at position 532, 538, 542, and/or 595 of LbCas13, or the corresponding position of an AsCas13 orthologue, homologue, or variant, preferably mutated amino acid residues at positions 532 or 532 and 595, wherein said mutations preferably are 532R and 595R, such as G532R and K595R; or preferably mutated amino acid residues at positions 532 and 538 (and optionally 542), wherein said mutations preferably are 532R and 538V (and optionally 542R), such as G532R and K538V (and optionally Y542R), most preferably wherein said mutations are S542R and K607R, S542R and K548V, or S542R, K548V and N552R of AsCas13.

Deactivated/Inactivated Cas13 Protein

Where the Cas13 protein has nuclease activity, the Cas13 protein may be modified to have diminished nuclease activity e.g., nuclease inactivation of at least 70%, at least 80%, at least 90%, at least 95%, at least 97%, or 100% as compared with the wild type enzyme; or to put in another way, a Cas13 enzyme having advantageously about 0% of the nuclease activity of the non-mutated or wild type Cas13 enzyme or CRISPR-Cas protein, or no more than about 3% or about 5% or about 10% of the nuclease activity of the non-mutated or wild type Cas13 enzyme, e.g. of the non-mutated or wild type *Francisella novicida* U112 (FnCas13), *Acidaminococcus* sp. BV3L6 (AsCas13), Lachnospiraceae bacterium ND2006 (LbCas13) or *Moraxella bovoculi* 237 (MbCas13 Cas13 enzyme or CRISPR-Cas protein. This is possible by introducing mutations into the nuclease domains of the Cas13 and orthologs thereof.

In preferred embodiments of the present invention at least one Cas13 protein is used which is a Cas13 nickase. More particularly, a Cas13 nickase is used which does not cleave the target strand but is capable of cleaving only the strand which is complementary to the target strand, i.e. the non-target DNA strand also referred to herein as the strand which is not complementary to the guide sequence. More particularly the Cas13 nickase is a Cas13 protein which comprises a mutation in the arginine at position 1226A in the Nuc domain of Cas13 from *Acidaminococcus* sp., or a corresponding position in a Cas13 ortholog. In further particular embodiments, the enzyme comprises an arginine-to-alanine substitution or an R1226A mutation. It will be understood by the skilled person that where the enzyme is not AsCas13, a mutation may be made at a residue in a corresponding position. In particular embodiments, the Cas13 is FnCas13 and the mutation is at the arginine at position R1218. In particular embodiments, the Cas13 is LbCas13 and the mutation is at the arginine at position R1138. In particular embodiments, the Cas13 is MbCas13 and the mutation is at the arginine at position R1293.

In certain embodiments, use is made additionally or alternatively of a CRISPR-Cas protein which is engineered and can comprise one or more mutations that reduce or eliminate a nuclease activity. The amino acid positions in the FnCas13p RuvC domain include but are not limited to D917A, E1006A, E1028A, D1227A, D1255A, N1257A, D917A, E1006A, E1028A, D1227A, D1255A and N1257A. Applicants have also identified a putative second nuclease domain which is most similar to PD-(D/E)XK nuclease superfamily and HincII endonuclease like. The point mutations to be generated in this putative nuclease domain to substantially reduce nuclease activity include but are not limited to N580A, N584A, T587A, W609A, D610A, K613A, E614A, D616A, K624A, D625A, K627A and Y629A. In a preferred embodiment, the mutation in the FnCas13p RuvC domain is D917A or E1006A, wherein the D917A or E1006A mutation completely inactivates the DNA cleavage activity of the FnCas13 effector protein. In another embodiment, the mutation in the FnCas13p RuvC domain is D1255A, wherein the mutated FnCas13 effector protein has significantly reduced nucleolytic activity.

More particularly, the inactivated Cas13 enzymes include enzymes mutated in amino acid positions As908, As993, As1263 of AsCas13 or corresponding positions in Cas13 orthologs. Additionally, the inactivated Cas13 enzymes include enzymes mutated in amino acid position Lb832, 925, 947 or 1180 of LbCas13 or corresponding positions in Cas13 orthologs. More particularly, the inactivated Cas13 enzymes include enzymes comprising one or more of mutations AsD908A, AsE993A, AsD1263A of AsCas13 or corresponding mutations in Cas13 orthologs. Additionally, the inactivated Cas13 enzymes include enzymes comprising one or more of mutations LbD832A, E925A, D947A or D1180A of LbCas13 or corresponding mutations in Cas13 orthologs.

Mutations can also be made at neighboring residues, e.g., at amino acids near those indicated above that participate in the nuclease activity. In some embodiments, only the RuvC domain is inactivated, and in other embodiments, another putative nuclease domain is inactivated, wherein the effector protein complex functions as a nickase and cleaves only one DNA strand. In a preferred embodiment, the other putative nuclease domain is a HincII-like endonuclease domain.

The inactivated Cas13 or Cas13 nickase may have associated (e.g., via fusion protein) one or more functional domains, including for example, an adenosine deaminase or catalytic domain thereof. In some cases it is advantageous that additionally at least one heterologous NLS is provided. In some instances, it is advantageous to position the NLS at the N terminus. In general, the positioning of the one or more functional domain on the inactivated Cas13 or Cas13 nickase is one which allows for correct spatial orientation for the functional domain to affect the target with the attributed functional effect. For example, when the functional domain is an adenosine deaminase catalytic domain thereof, the adenosine deaminase catalytic domain is placed in a spatial orientation which allows it to contact and deaminate a target adenine. This may include positions other than the N-/C-terminus of Cas13. In some embodiments, the adenosine deaminase protein or catalytic domain thereof is inserted into an internal loop of Cas13.

Determination of PAM

Determination of PAM can be ensured as follows. This experiment closely parallels similar work in *E. coli* for the heterologous expression of StCas9 (Sapranauskas, R. et al. Nucleic Acids Res 39, 9275-9282 (2011)). Applicants introduce a plasmid containing both a PAM and a resistance gene into the heterologous *E. coli*, and then plate on the corresponding antibiotic. If there is DNA cleavage of the plasmid, Applicants observe no viable colonies.

In further detail, the assay is as follows for a DNA target. Two *E. coli* strains are used in this assay. One carries a plasmid that encodes the endogenous effector protein locus from the bacterial strain. The other strain carries an empty plasmid (e.g. pACYC184, control strain). All possible 7 or 8 bp PAM sequences are presented on an antibiotic resistance plasmid (pUC19 with ampicillin resistance gene). The PAM is located next to the sequence of proto-spacer 1 (the DNA target to the first spacer in the endogenous effector protein locus). Two PAM libraries were cloned. One has a 8 random bp 5' of the proto-spacer (e.g. total of 65536 different PAM sequences=complexity). The other library has 7 random bp 3' of the proto-spacer (e.g. total complexity is 16384 different PAMs). Both libraries were cloned to have in average 500 plasmids per possible PAM. Test strain and control strain were transformed with 5'PAM and 3'PAM library in separate transformations and transformed cells were plated separately on ampicillin plates. Recognition and subsequent cutting/interference with the plasmid renders a cell vulnerable to ampicillin and prevents growth. Approximately 12 h after transformation, all colonies formed by the test and control strains where harvested and plasmid DNA was isolated. Plasmid DNA was used as template for PCR amplification and subsequent deep sequencing. Representation of all PAMs in the untransformed libraries showed the expected representation of PAMs in transformed cells. Representation of all PAMs found in control strains showed the actual representation. Representation of all PAMs in test strain showed which PAMs are not recognized by the enzyme and comparison to the control strain allows extracting the sequence of the depleted PAM.

The following PAMs have been identified for certain wild-type Cas13 orthologues: the *Acidaminococcus* sp. BV3L6 Cas13 (AsCas13), *Lachnospiraceae* bacterium ND2006 Cas13 (LbCas13) and *Prevotella albensis* (PaCas13) can cleave target sites preceded by a TTTV PAM, where V is A/C or G, FnCas13p, can cleave sites preceded by TTN, where N is A/C/G or T. The *Moraxella bovoculi* AAX08_00205, *Moraxella bovoculi* AAX11_00205, *Butyrivibrio* sp. NC3005, *Thiomicrospira* sp. XS5, or *Lachnospiraceae* bacterium MA2020 PAM is 5' TTN, where N is A/C/G or T. The natural PAM sequence is TTTV or BTTV, wherein B is T/C or G and V is A/C or G and the effector protein is *Moraxella lacunata* Cas13.

Codon Optimized Nucleic Acid Sequences

Where the effector protein is to be administered as a nucleic acid, the application envisages the use of codon-optimized CRISPR-Cas type V protein, and more particularly Cas13-encoding nucleic acid sequences (and optionally protein sequences). An example of a codon optimized sequence, is in this instance a sequence optimized for expression in a eukaryote, e.g., humans (i.e. being optimized for expression in humans), or for another eukaryote, animal or mammal as herein discussed; see, e.g., SaCas9 human codon optimized sequence in WO 2014/093622 (PCT/US2013/074667) as an example of a codon optimized sequence (from knowledge in the art and this disclosure, codon optimizing coding nucleic acid molecule(s), especially as to effector protein (e.g., Cas13) is within the ambit of the skilled artisan). Whilst this is preferred, it will be appreciated that other examples are possible and codon optimization for a host species other than human, or for codon optimization for specific organs is known. In some embodiments, an enzyme coding sequence encoding a DNA/RNA-targeting Cas protein is codon optimized for expression in particular cells, such as eukaryotic cells. The eukaryotic cells may be those of or derived from a particular organism, such as a plant or a mammal, including but not limited to human, or non-human eukaryote or animal or mammal as herein discussed, e.g., mouse, rat, rabbit, dog, livestock, or non-human mammal or primate. In some embodiments, processes for modifying the germ line genetic identity of human beings and/or processes for modifying the genetic identity of animals which are likely to cause them suffering without any substantial medical benefit to man or animal, and also animals resulting from such processes, may be excluded. In general, codon optimization refers to a process of modifying a nucleic acid sequence for enhanced expression in the host cells of interest by replacing at least one codon (e.g., about or more than about 1, 2, 3, 4, 5, 10, 15, 20, 25, 50, or more codons) of the native sequence with codons that are more frequently or most frequently used in the genes of that host cell while maintaining the native amino acid sequence. Various species exhibit particular bias for certain codons of a particular amino acid. Codon bias (differences in codon usage between organisms) often correlates with the efficiency of translation of messenger RNA (mRNA), which is in turn believed to be dependent on, among other things, the properties of the codons being translated and the availability of particular transfer RNA (tRNA) molecules. The predominance of selected tRNAs in a cell is generally a reflection of the codons used most frequently in peptide synthesis. Accordingly, genes can be tailored for optimal gene expression in a given organism based on codon optimization. Codon usage tables are readily available, for example, at the "Codon Usage Database" available at www.kazusa.orjp/codon/and these tables can be adapted in a number of ways. See Nakamura, Y., et al. "Codon usage tabulated from the international DNA sequence databases: status for the year 2000" Nucl. Acids Res. 28:292 (2000). Computer algorithms for codon optimizing a particular sequence for expression in a particular host cell are also available, such as Gene Forge (Aptagen; Jacobus, PA), are also available. In some embodiments, one or more codons (e.g., 1, 2, 3, 4, 5, 10, 15, 20, 25, 50, or more, or all codons) in a sequence encoding a DNA/RNA-targeting Cas protein corresponds to the most frequently used codon for a particular amino acid. As to codon usage in yeast, reference is made to the online Yeast Genome database available at yeastgenome.org/community/codon_usage.shtml, or Codon selection in yeast, Bennetzen and Hall, J Biol Chem. 1982 Mar. 25; 257(6):3026-31. As to codon usage in plants including algae, reference is made to Codon usage in higher plants, green algae, and cyanobacteria, Campbell and Gowri, Plant Physiol. 1990 January; 92(1): 1-11; as well as Codon usage in plant genes, Murray et al, Nucleic Acids Res. 1989 Jan. 25; 17(2):477-98; or Selection on the codon bias of chloroplast and cyanelle genes in different plant and algal lineages, Morton B R, J Mol Evol. 1998 April; 46(4):449-59.

In certain example embodiments, the CRISPR Cas protein is selected from Table 1.

TABLE 1

| C2c2 orthologue | Code | Multi Letter |
|---|---|---|
| *Leptotrichia shahii* | C2-2 | Lsh |
| *L wadei* F0279 (Lw2) | C2-3 | Lw2 |
| *Listeria seeligeri* | C2-4 | Lse |
| *Lachnospiraceae* bacterium MA2020 | C2-5 | LbM |
| *Lachnospiraceae* bacterium NK4A179 | C2-6 | LbNK179 |
| [*Clostridium*] *aminophilum* DSM 10710 | C2-7 | Ca |
| *Carnobacterium gallinarum* DSM 4847 | C2-8 | Cg |
| *Carnobacterium gallinarum* DSM 4847 | C2-9 | Cg2 |
| *Paludibacter propionicigenes* WB4 | C2-10 | Pp |
| *Listeria weihenstephanensis* FSL R9-0317 | C2-11 | Lwei |
| *Listeriaceae* bacterium FSL M6-0635 | C2-12 | LbFSL |
| *Leptotrichia wadei* F0279 | C2-13 | Lw |
| *Rhodobacter capsulatus* SB 1003 | C2-14 | Rc |
| *Rhodobacter capsulatus* R121 | C2-15 | Rc |
| *Rhodobacter capsulatus* DE442 | C2-16 | Rc |

In certain example embodiments, the CRISPR effector protein is a Cas13a protein selected from Table 2

TABLE 2

```
c2c2-5    1   Lachnospiraceae   MQISKVNHKHVAVGQKDRERITGFIYNDPVGDEKSLEDVVA
              bacterium         KRANDTKVLFNVFNTKDLYDSQESDKSEKDKEIISKGAKFV
              MA2020            AKSFNSAITILKKQNKIYSTLTSQQVIKELKDKFGGARIYD
              (SEQ ID           DDIEEALTETLKKSFRKENVRNSIKVLIENAAGIRSSLSKD
              No. 34)           EEELIQEYFVKQLVEEYTKTKLQKNVVKSIKNQNMVIQPDS
```

TABLE 2-continued

|  |  |  |  |
|---|---|---|---|
|  |  |  | DSQVLSLSESRREKQSSAVSSDTLVNCKEKDVLKAFLTDYA |
|  |  |  | VLDEDERNSLLWKLRNLVNLYFGSESIRDYSYTKEKSVWK |
|  |  |  | EHDEQKANKTLFIDEICHITKIGKNGKEQKVLDYEENRSRC |
|  |  |  | RKQNINYYRSALNYAKNNTSGIFENEDSNHFWIHLIENEVE |
|  |  |  | RLYNGIENGEEFKFETGYISEKVWKAVINHLSIKYIALGKA |
|  |  |  | VYNYAMKELSSPGDIEPGKIDDSYINGITSFDYEIIKAEES |
|  |  |  | LQRDISMNVVFATNYLACATVDTDKDFLLFSKEDIRSCTKK |
|  |  |  | DGNLCKNIMQFWGGYSTWKNFCEEYLKDDKDALELLYSLKS |
|  |  |  | MLYSMRNSSFHFSTENVDNGSWDTELIGKLFEEDCNRAARI |
|  |  |  | EKEKFYNNNLHMFYSSSLLEKVLERLYSSHHERASQVPSFN |
|  |  |  | RVFVRKNFPSSLSEQRITPKFTDSKDEQIWQSAVYYLCKEI |
|  |  |  | YYNDFLQSKEAYKLFREGVKNLDKNDINNQKAADSFKQAVV |
|  |  |  | YYGKAIGNATLSQVCQAIMTEYNRQNNDGLKKKSAYAEKQN |
|  |  |  | SNKYKHYPLFLKQVLQSAFWEYLDENKEIYGFISAQIHKSN |
|  |  |  | VEIKAEDFIANYSSQQYKKLVDKVKKTPELQKWYTLGRLIN |
|  |  |  | PRQANQFLGSIRNYVQFVKDIQRRAKENGNPIRNYYEVLES |
|  |  |  | DSIIKILEMCTKLNGTTSNDIHDYFRDEDEYAEYISQFVNF |
|  |  |  | GDVHSGAALNAFCNSESEGKKNGIYYDGINPIVNRNWVLCK |
|  |  |  | LYGSPDLISKITSRVNENMIHDFHKQEDLIREYQIKGICSN |
|  |  |  | KKEQQDLRTFQVLKNRVELRDIVEYSEIINELYGQLIKWCY |
|  |  |  | LRERDLMYFQLGFHYLCLNNASSKEADYIKINVDDRNISGA |
|  |  |  | ILYQIAAMYINGLPVYYKKDDMYVALKSGKKASDELNSNEQ |
|  |  |  | TSKKINYFLKYGNNILGDKKDQLYLAGLELFENVAEHENII |
|  |  |  | IFRNEIDHFHYFYDRDRSMLDLYSEVFDRFFTYDMKLRKNV |
|  |  |  | VNMLYNILLDHNIVSSFVFETGEKKVGRGDSEVIKPSAKIR |
|  |  |  | LRANNGVSSDVFTYKVGSKDELKIATLPAKNEEFLLNVARL |
|  |  |  | IYYPDMEAVSENMVREGVVKVEKSNDKKGKISRGSNTRSSN |
|  |  |  | QSKYNNKSKNRMNYSMGSIFEKMDLKFD |
| c2c2-6 | 2 | Lachnospiraceae<br>bacterium<br>NK4A179<br>(SEQ ID<br>No. 35) | MKISKVREENRGAKLTVNAKTAVVSENRSQEGILYNDPSRY<br>GKSRKNDEDRDRYIESRLKSSGKLYRIFNEDKNKRETDELQ<br>WFLSEIVKKINRRNGLVLSDMLSVDDRAFEKAFEKYAELSY<br>TNRRRNKVSGSPAFETCGVDAATAERLKGIISETNFINRIKN<br>NIDNKVSEDIIDRIIAKYLKKSLCRERVKRGLKKLLMNAFD<br>LPYSDPDIDVQRDFIDYVLEDFYHVRAKSQVSRSIKNMNMP<br>VQPEGDGKFAITVSKGGTESGNKRSAEKEAFKKFLSDYASL<br>DERVRDDMLRRMRRLVVLYFYGSDDSKLSDVNEKFDVWEDH<br>AARRVDNREFIKLPLENKLANGKTDKDAERIRKNTVKELYR<br>NQNIGCYRQAVKAVEEDNNGRYFDDKMLNMFFIHRIEYGVE<br>KIYANLKQVTEFKARTGYLSEKIWKDLINYISIKYIAMGKA<br>VYNYAMDELNASDKKEIELGKISEEYLSGISSFDYELIKAE<br>EMLQRETAVYVAFAARHLSSQTVELDSENSDFLLLKPKGTM<br>DKNDKNKLASNNILNFLKDKETLRDTILQYFGGHSLWTDFP<br>FDKYLAGGKDDVDFLTDLKDVIYSMRNDSFHYATENHNNGK<br>WNKELISAMFEHETERMTVVMKDKFYSNNLPMFYKNDDLKK<br>LLIDLYKDNVERASQVPSFNKVFVRKNFPALVRDKDNLGIE<br>LDLKADADKGENELKFYNALYYMFKEIYYNAFLNDKNVRER<br>FITKATKVADNYDRNKERNLKDRIKSAGSDEKKKLREQLQN<br>YIAAENDFGQRIKNIVQVNPDYTLAQICQLIMTEYNQQNNGC<br>MQKKSAARKDINKDSYQHYKMLLLVNLRKAFLEFIKENYAF<br>VLKPYKHDLCDKADFVPDFAKYVKPYAGLISRVAGSSELQK<br>WYIVSRFLSPAQANHMLGFLHSYKQYVWDIYRRASETGTEI<br>NHSIAEDKIAGVDITDVDAVIDLSVKLCGTISSEISDYFKD<br>DEVYAEYISSYLDFEYDGGNYKDSLNRFCNSDAVNDQKVAL<br>YYDGEHPKLNRNIILSKLYGERRFLEKITDRVSRSDIVEYY<br>KLKKETSQYQTKGIFDSEDEQKNIKKFQEMKNIVEFRDLMD<br>YSEIADELQGQLINWIYLRERDLMNFQLGYHYACLNNDSNK<br>QATYVTLDYQGKKNRKINGAILYQICAMYINGLPLYYVDKD<br>SSEWTVSDGKESTGAKIGEFYRYAKSFENTSDCYASGLEIF<br>ENISEHDNITELRNYIEHFRYYSSFDRSFLGIYSEVFDRFF<br>TYDLKYRKNVPTILYNILLQHFVNVRFEFVSGKKMIGIDKK<br>DRKIAKEKECARITIREKNGVYSEQFTYKLKNGTVYVDARD<br>KRYLQSIIRLLFYPEKVNMDEMIEVKEKKKPSDNNTGKGYS<br>KRDRQQDRKEYDKYKEKKKKEGNFLSGMGGNINWDEINAQL<br>KN |
| c2c2-7 | 3 | [Clostridium]<br>aminophilum<br>DSM<br>10710<br>SEQ ID<br>No. 36) | MKFSKVDHTRSAVGIQKATDSVHGMLYTDPKKQEVNDLDKR<br>FDQLNVKAKRLYNVFNQSKAEEDDDEKRFGKVVKKLNRELK<br>DLLFPHREVSRYNSIGNAKYNYYGIKSNPEEIVSNLGMVESL<br>KGERDPQKVISKLLLYYLRKGLKPGTDGLRMILEASCGLRK<br>LSGDEKELKVFLQTLDEDFEKKTFKKNLIRSIENQNMAVQP<br>SNEGDPIIGITQGRFNSQKNEEKSAIERMMSMYADLNEDHR<br>EDVLRKLRRLNVLYFNVDTEKTEEPTLPGEVDTNPVFEVWH<br>DHEKGKENDRQFATFAKILTEDRETRKKEKLAVKEALNDLK<br>SAIRDHNIMAYRCSIKVTEQDKDGLFFEDQRINRFWIHHIE<br>SAVERILASINPEKLYKLRIGYLGEKVWKDLLNYLSIKYIA<br>VGKAVFHPAMEDLGKTGQDIELGKLSNSVSGGLTSFDYEQI<br>RADETLQRQLSVEVAFAANNLFRAVVGQTGKKIEQSKSEEN<br>EEDFLLWKAEKIAESIKKEGEGNTLKSILQFFGGASSWDLN<br>HFCAAYGNESSALGYETKFADDLRKAIYSLRNETFHFTTLN |

TABLE 2-continued

|  |  |  | |
|---|---|---|---|
| | | | KGSFDWNAKLIGDMFSHEAATGIAVERTRFYSNNLPMFYRE
SDLKRIMDHLYNTYHPRASQVPSFNSVFVRKNFRLFLSNTL
NTNTSFDTEVYQKWESGVYYLFKEIYYNSFLPSGDAHHLFF
EGLRRIRKEADNLPIVGKEAKKRNAVQDFGRRCDELKNLSL
SAICQMIMTEYNEQNNGNRKVKSTREDKRKPDIFQHYKMLL
LRTLQEAFAIYIRREEFKFIFDLPKTLYVMKPVEEFLPNWK
SGMFDSLVERVKQSPDLQRWYVLCKFLNGRLLNQLSGVIRS
YIQFAGDIQRRAKANHNRLYMDNTQRVEYYSNVLEVVDFCI
KGTSRFSNVFSDYFRDEDAYADYLDNYLQFKDEKIAEVSSF
AALKTFCNEEEVKAGIYMDGENPVMQRNIVMAKLFGPDEVL
KNVVPKVTREEIEEYYQLEKQIAPYRQNGYCKSEEDQKKLL
RFQRIKNRVEFQTITEFSEIINELLGQLISWSFLRERDLLY
FQLGFHYLCLHNDTEKPAEYKEISREDGTVIRNAILHQVAA
MYVGGLPVYTLADKKLAAFEKGEADCKLSISKDTAGAGKKI
KDFFRYSKYVLIKDRMLTDQNQKYTIYLAGLELFENTDEHD
NITDVRKYVDHFKYYATSDENAMSILDLYSEIHDRFFTYDM
KYQKNVANMLENILLRHFVLIRPEFFTGSKKVGEGKKITCK
ARAQIEIAENGMRSEDFTYKLSDGKKNISTCMIAARDQKYL
NTVARLLYYPHEAKKSIVDTREKKNNKKTNRGDGTFNKQKG
TARKEKDNGPREFNDTGFSNTPFAGFDPFRNS |
| c2c2-8 | 5 | Carnobacterium
gallinarum
DSM4847
(SEQ ID
No. 37) | MRITKVKIKLDNKLYQVTMQKEEKYGTLKLNEESRKSTAEI
LRLKKASFNKSFHSKTINSQKENKNATIKKNGDYISQIFEK
LVGVDTNKNIRKPKMSLTDLKDLPKKDLALFIKRKFKNDDI
VEIKNLDLISLFYNALQKVPGEHFTDESWADFCQEMMPYRE
YKNKFIERKIILLANSIEQNKGFSINPETFSKRKRVLHQWA
IEVQERGDFSILDEKLSKLAEIYNFKKMCKRVQDELNDLEK
SMKKGKNPEKEKEAYKKQKNFKIKTIWKDYPYKTHIGLIEK
IKENEELNQFNIEIGKYFEHYFPIKKERCTEDEPYYLNSET
IATTVNYQLKNALISYLMQIGKYKQFGLENQVLDSKKLQEI
GIYEGFQTKFMDACVFATSSLKNIIEPMRSGDILGKREFKE
AIATSSFVNYHHFFPYFPPELKGMKDRESELIPFGEQTEAK
QMQNIWALRGSVQQIRNEIFHSFDKNQKFNLPQLDKSNFEF
DASENSTGKSQSYIETDYKFLFEAEKNQLEQFFIERIKSSG
ALEYYPLKSLEKLFAKKEMKFSLGSQVVAFAPSYKKLVKKG
HSYQTATEGTANYLGLSYYNRYELKEESFQAQYYLLKLIYQ
YVFLPNFSQGNSPAFRETVKAILRINKDEARKKMKKNKKFL
RKYAFEQVREMEFKETPDQYMSYLQSEMREEKVRKAEKNDK
GFEKNITMNFEKLLMQIFVKGFDVFLTTFAGKELLLSSEEK
VIKETEISLSKKINEREKTLKASIQVEHQLVATNSAISYWL
FCKLLDSRHLNELRNEMIKFQSRIKFNHTQHAELIQNLLP
IVELTILSNDYDEKNDSQNVDVSAYFEDKSLYETAPYVQTD
DRTRVSFRPILKLEKYHTKSLIEALLKDNPQFRVAATDIQE
WMHKREEIGELVEKRKNLHTEWAEGQQTLGAEKREEYRDYC
KKIDRFNWKANKVTLTYLSQLHYLITDLLGRMVGFSALFER
DLVYFSRSFSELGGETYHISDYKNLSGVLRLNAEVKPIKIK
NIKVIDNEENPYKGNEPEVKPFLDRLHAYLENVIGIKAVHG
KIRNQTAHLSVLQLELSMIESMNNLRDLMAYDRKLKNAVTK
SMIKILDKHGMILKLKIDENHKNFEIESLIPKEIIHLKDKA
IKTNQVSEEYCQLVLALLTTNPGNQLN |
| c2c2-9 | 6 | Carnobacterium
gallinarum
DSM4847
(SEQ ID
No. 38) | MRMTKVKINGSPVSMNRSKLNGHLVWNGTTNTVNILTKKEQ
SFAASFLNKTLVKADQVKGYKVLAENIFIIFEQLEKSNSEK
PSVYLNNIRRLKEAGLKRFFKSKYHEEIKYTSEKNQSVPTK
LNLIPLFFNAVDRIQEDKFDEKNWSYFCKEMSPYLDYKKSY
LNRKKEILANSIQQNRGFSMPTAEEPNLLSKRKQLFQQWAM
KFQESPLIQQNNFAVEQFNKEFANKINELAAVYNVDELCTA
ITEKLMNFDKDKSNKTRNFEIKKLWKQHPHNKDKALIKLFN
QEGNEALNQFNIELGKYFEHYFPKTGKKESAESYYLNPQTI
IKTVGYQLRNAFVQYLLQVGKLHQYNKGVLDSQTLQEIGMY
EGFQTKFMDACVFASSSLRNIIQATTNEDILTREKFKKELE
KNVELKHDLFFKTEIVEERDENPAKKIAMTPNELDDLWAIRG
AVQRVRNQIFHQQINKRHEPNQLKVGSFENGDLGNVSYQKT
IYQKLFDAEIKDIEIYFAEKIKSSGALEQYSMKDLEKLFSN
KELTLSLGGQVVAFAPSYKKLYKQGYFYQNEKTIELEQFTD
YDFSNDVFKANYYLIKLIYHYVFLPQFSQANNKLFKDTVHY
VIQQNKELNTTEKDKKNNKKIRKYAFEQVKLMKNESPEKYM
QYLQREMQEERTIKEAKKTNEEKPNYNFEKLLIQIFIKGFD
TFLRNFDLNLNPAEELVGTVKEKAEGLRKRKERIAKILNVD
EQIKTGDEEIAFWIFAKLLDARHLSELRNEMIKFKQSSVKK
GLIKNGDLIEQMQPILELCILSNDSESMEKESFDKIEVFLE
KVELAKNEPYMQEDKLTPVKFRFMKQLEKYQTRNFIENLVI
ENPEFKVSEKIVLNWHEEKEKIADLVDKRTKLHEEWASKAR
EIEEYNEKIKKNKSKKLDKPAEFAKFAEYKIICEAIENFNR
LDHKVRLTYLKNLHYLMIDLMGRMVGFSVLFERDFVYMGRS
YSALKKQSIYLNDYDTFANIRDWEVNENKHLFGTSSSDLTF
QETAEFKNLKKPMENQLKALLGVTNHSFEIRNNIAHLVLR
NDGKGEGVSLLSCMNDLRKLMSYDRKLKNAVTKAIIKILDK
HGMILKLTNNDHTKPFEIESLKPKKIIHLEKSNHSFPMDQV
SQEYCDLVKKMLVFTN |

TABLE 2-continued

| | | | |
|---|---|---|---|
| c2c2-10 | 7 | *Paludibacter propionicigenes* WB4 (SEQ ID No. 39) | MRVSKVKVKDGGKDKMVLVHRKTTGAQLVYSGQPVSNETSN ILPEKKRQSFDLSTLNKTIIKFDTAKKQKLNVDQYKIVEKI FKYPKQELPKQIKAEEILPFLNHKFQEPVKWKNGKEESFNL TLLIVEAVQAQDKRKLQPYYDWKTWYIQTKSDLLKKSIENN RIDLTENLSKRKKALLAWETEFTASGSIDLTHYHKVYMTDV LCKMLQDVKPLTDDKGKINTNAYHRGLKKALQNHQPAIFGT REVPNEANRADNQLSIYHLEVVKYLEHYFPIKTSKRRNTAD DIAHYLKAQTLKTTIEKQLVNAIRANIIQQGKTNHHELKAD TTSNDLIRIKTNEAFVLNLTGTCAFAANNIRNMVDNEQTND ILGKGDFIKSLLKDNTNSQLYSFFFGEGLSTNKAEKETQLW GIRGAVQQIRNNVNHYKKDALKTVFNISNFENPTITDPKQQ TNYADTIYKARFINELEKIPEAFAQQLKTGGAVSYYTIENL KSLLTTFQFSLCRSTIPFAPGFKKVFNGGINYQNAKQDESF YELMLEQYLRKENFAEESYNARYFMLKLIYNNLFLPGFTTD RKAFADSVGFVQMQNKKQAEKVNPRKKEAYAFEAVRPMTAA DSIADYMAYVQSELMQEQNKKEEKVAEETRINFEKFVLQVF IKGFDSFLRAKEFDFVQMPQPQLTATASNQQKADKLNQLEA SITADCKLTPQYAKADDATHIAFYVFCKLLDAAHLSNLRNE LIKFRESVNEFKFHHLLEIIEICLLSADVVPTDYRDLYSSE ADCLARLRPFIEQGADITNWSDLFVQSDKHSPVIHANIELS VKYGTTKLLEQIINKDTQFKTTEANFTAWNTAQKSIEQLIK QREDHHEQWVKAKNADDKEKQERKREKSNFAQKFIEKHGDD YLDICDYINTYNWLDNKMHFVHLNRLHGLTIELLGRMAGFV ALFDRDFQFFDEQQIADEFKLHGVNLHSIDKKLNEVPTKK IKEIYDIRNKIIQINGNKINESVRANLIQFISSKRNYYNNA FLHVSNDEIKEKQMYDIRNHIAHFNYLTKDAADFSLIDLIN ELRELLHYDRKLKNAVSKAFIDLFDKHGMILKLKLNADHKL KVESLEPKKIYHLGSSAKDKPEYQYCTNQVMMAYCNMCRSL LEMKK |
| c2c2-11 | 9 | *Listeria weihenstephanensis* FSL R9-0317 (SEQ ID No. 40) | MLALLHQEVPSQKLHNLKSLNTESLTKLFKPKFQNMISYPP SKGAEHVQFCLTDIAVPAIRDLDEIKPDWGIFFEKLKPYTD WAESYIHYKQTTIQKSIEQNKIQSPDSPRKLVLQKYVTAFL NGEPLGLDLVAKKYKLADLAESFKVVDLNEDKSANYKIKAC LQQHQRNILDELKEDPELNQYGIEVKKYIQRYFPIKRAPNR SKHARADFLKKELIESTVEQQFKNAVYHYVLEQGKMEAYEL TDPKTKDLQDIRSGEAFSFKFINACAFASNNLKMILNPECE KDILGKGDFKKNLPNSTTQSDVVKKMIPFFSDEIQNVNFDE AIWAIRGSIQQIRNEVYHCKKHSWKSILKIKGFEFEPNNMK YTDSDMQKLMDKDIAKIPDFIEEKLKSSGIIRFYSHDKLQS IWEMKQGFSLLTTNAPFVPSFKRVYAKGHDYQTSKNRYYDL GLTTFDILEYGEEDFRARYFLTKLVYYQQFMPWFTADNNAF RDAANFVLRLNKNRQQDAKAFINIREVEEGEMPRDYMGYVQ GQIAIHEDSTEDTPNHFEKFISQVFIKGFDSHMRSADLKFI KNPRNQGLEQSEIEEMSFDIKVEPSFLKNKDDYIAFWTFCK MLDARHLSELRNEMIKYDGHLTGEQEIIGLALLGVDSREND WKQFFSSEREYEKIMKGYVGEELYQREPYRQSDGKTPILFR GVEQARKYGTETVIQRLFDASPEFKVSKCNITEWERQKETI EETIERRKELHNEWEKNPKKPQNNAFFKEYKECCDAIDAYN WHKNKTTLVYVNELHHLLIEILGRYVGYVAIADRDFQCMAN QYFKHSGITERVEYWGDNRLKSIKKLDTFLKKEGLFVSEKN ARNHIAHLNYLSLKSECTLLYLSERLREIFKYDRKLKNAVS KSLIDILDRHGMSVVFANLKENKHRLVIKSLEPKKLRHLGE KKIDNGYIETNQVSEEYCGIVKRLLEI |
| c2c2-12 | 10 | *Listeriaceae bacterium* FSL M6-0635 = *Listeria newyorkensis* FSL M6-0635 (SEQ ID No. 41) | MKITKMRVDGRTIVMERTSKEGQLGYEGIDGNKTTEIIFDK KKESFYKSILNKTVRKPDEKEKNRRKQAINKAINKEITELM LAVLHQEVPSQKLHNLKSLNTESLTKLFKPKFQNMISYPPS KGAEHVQFCLTDIAVPAIRDLDEIKPDWGIFFEKLKPYTDW AESYIHYKQTTIQKSIEQNKIQSPDSPRKLVLQKYVTAFLN GEPLGLDLVAKKYKLADLAESFKLVDLNEDKSANYKIKACL QQHQRNILDELKEDPELNQYGIEVKKYIQRYFPIKRAPNRS KHARADFLKKELIESTVEQQFKNAVYHYVLEQGKMEAYELT DPKTKDLQDIRSGEAFSFKFINACAFASNNLKMILNPECEK DILGKGNFKKNLPNSTTRSDVVKKMIPFFSDELQNVNFDEA IWAIRGSIQQIRNEVYHCKKHSWKSILKIKGFEFEPNNMKY ADSDMQKLMDKDIAKIPEFIEEKLKSSGVVRFYRHDELQSI WEMKQGFSLLTTNAPFVPSFKRVYAKGHDYQTSKNRYYNLD LTTFDILEYGEEDFRARYFLTKLVYYQQFMPWFTADNNAFR DAANFVLRLNKNRQQDAKAFINIREVEEGEMPRDYMGYVQG QIAIHEDSIEDTPNHFEKFISQVFIKGFDRHMRSANLKFIK NPRNQGLEQSEIEEMSFDIKVEPSFLKNKDDYIAFWIFCKM LDARHLSELRNEMIKYDGHLTGEQEIIGLALLGVDSRENDW KQFFSSEREYEKIMKGYVVEELYQREPYRQSDGKTPILFRG VEQARKYGTETVIQRLFDANPEFKVSKCNLAEWERQKETIE ETIKRRKELHNEWAKNPKKPQNNAFFKEYKECCDAIDAYNW HKNKTTLAYVNELHHLLIEILGRYVGYVAIADRDFQCMANQ YFKHSGITERVEYWGDNRLKSIKKLDTFLKKEGLFVSEKNA RNHIAHLNYLSLKSECTLLYLSERLREIFKYDRKLKNAVSK |

TABLE 2-continued

| | | | |
|---|---|---|---|
| | | | SLIDILDRHGMSVVFANLKENKHRLVIKSLEPKKLRHLGGK<br>KIDGGYIETNQVSEEYCGIVKRLLEM |
| c2c2-13 | 12 | *Leptotrichia*<br>*wadei*<br>F0279<br>(SEQ ID<br>No. 42) | MKVTKVDGISHKKYIEEGKLVKSTSEENRTSERLSELLSIR<br>LDIYIKNPDNASEEENRIRRENLKKFFSNKVLHLKDSVLYL<br>KNRKEKNAVQDKNYSEEDISEYDLKNKNSFSVLKKILLNED<br>VNSEELEIFRKDVEAKLNKINSLKYSFEENKANYQKINENN<br>VEKVGGKSKRNIIYDYYRESAKRNDYINNVQEAFDKLYKKE<br>DIEKLFFLIENSKKHEKYKIREYYHKIIGRKNDKENFAKII<br>YEEIQNVNNIKELIEKIPDMSELKKSQVFYKYYLDKEELND<br>KNIKYAFCHFVEIEMSQLLKNYVYKRLSNISNDKIKRIFEY<br>QNLKKLIENKLLNKLDTYVRNCGKYNYYLQVGEIATSDFIA<br>RNRQNEAFLRNIIGVSSVAYFSLRNILETENENDITGRMRG<br>KTVKNNKGEEKYVSGEVDKIYNENKQNEVKENLKMFYSYDF<br>NMDNKNEIEDFFANIDEAISSIRHGIVHFNLELEGKDIFAF<br>KNIAPSEISKKMFQNEINEKKLKLKIFKQLNSANVFNYYEK<br>DVIIKYLKNTKFNFVNKNIPFVPSFTKLYNKIEDLRNTLKF<br>FWSVPKDKEEKDAQIYLLKNIYYGEFLNKFVKNSKVFFKIT<br>NEVIKINKQRNQKTGHYKYQKFENIEKTVPVEYLAIIQSRE<br>MINNQDKEEKNTYIDFIQQIFLKGFIDYLNKNNLKYIESNN<br>NNDNNDIFSKIKIKKDNKEKYDKILKNYEKHNRNKEIPHEI<br>NEFVREIKLGKILKYTENLNMFYLILKLLNHKELTNLKGSL<br>EKYQSANKEETFSDELELINLLNLDNNRVTEDFELEANEIG<br>KFLDFNENKIKDRKELKKFDTNKIYFDGENIIKHRAFYNIK<br>KYGMLNLLEKIADKAKYKISLKELKEYSNKKNEIEKNYTMQ<br>QNLHRKYARPKKDEKFNDEDYKEYEKAIGNIQKYTHLKNKV<br>EFNELNLLQGLLLKILHRLVGYTSIWERDLRFRLKGEFPEN<br>HYIEEIFNFDNSKNVKYKSGQIVEKYINFYKELYKDNVEKR<br>SIYSDKKVKKLKQEKKDLYIRNYIAHFNYIPHAEISLLEVL<br>ENLRKLLSYDRKLKNAIMKSIVDILKEYGFVATFKIGADKK<br>IEIQTLESEKIVHLKNLKKKKLMTDRNSEELCELVKVMFEY<br>KALE |
| c2c2-14 | 15 | *Rhodobacter*<br>*capsulatus*<br>SB 1003<br>(SEQ ID<br>No. 43) | MQIGKVQGRTISEFGDPAGGLKRKISTDGKNRKELPAHLSS<br>DPKALIGQWISGIDKIYRKPDSRKSDGKAIHSPTPSKMQFD<br>ARDDLGEAFWKLVSEAGLAQSDYDQFKRRLHPYGDKFQPA<br>DSGAKLKFEADPPEPQAFHGRWYGAMSKRGNDAKELAAALY<br>EHLHVDEKRIDGQPKRNPKTDKFAPGLVVARALGIESSVLP<br>RGMARLARNWGEEEIQTYFVVDVAASVKEVAKAAVSAAQAF<br>DPPRQVSGRSLSPKVGFALAEHLERVTGSKRCSFDPAAGPS<br>VLALHDEVKKTYKRLCARGKNAARAFPADKTELLALMRHTH<br>ENRVRNQMVRMGRVSEYRGQQAGDLAQSHYWTSAGQTEIKE<br>SEIFVRLWVGAFALAGRSMKAWIDPMGKIVNTEKNDRDLTA<br>AVNIRQVISNKEMVAEAMARRGIYFGETPELDRLGAEGNEG<br>FVFALLRYLRGCRNQTFHLGARAGFLKEIRKELEKTRWGKA<br>KEAEHVVLTDKTVAAIRAIIDNDAKALGARLLADLSGAFVA<br>HYASKEHFSTLYSEIVKAVKDAPEVSSGLPRLKLLLKRADG<br>VRGYVHGLRDTRKHAFATKLPPPPAPRELDDDPATKARYIAL<br>LRLYDGPFRAYASGITGTALAGPAARAKEAATALAQSVNVT<br>KAYSDVMEGRTSRLRPPNDGETLREYLSALTGETATEFRVQ<br>IGYESDSENARKQAEFIENYRRDMLAFMFEDYIRAKGFDWI<br>LKIEPGATAMTRAPVLPEPIDTRGQYEHWQAALYLVMHFVP<br>ASDVSNLLHQLRKWEALQGKYELVQDGDATDQADARREALD<br>LVKRFRDVLVLFLKTGEARFEGRAAPFDLKPFRALFANPAT<br>FDRLFMATPTTARPAEDDPEGDGASEPELRVARTLRGLRQI<br>ARYNHMAVLSDLFAKHKVRDEEVARLAEIEDETQEKSQIVA<br>AQELRTDLHDKVMKCHPKTISPEERQSYAAAIKTIEEHRFL<br>VGRVYLGDHLRLHRLMMDVIGRLIDYAGAYERDTGTFLINA<br>SKQLGAGADWAVTIAGAANTDARTQTRKDLAHFNVLDRADG<br>TPDLTALVNRAREMMAYDRKRKNAVPRSILDMLARLGLTLK<br>WQMKDHLLQDATITQAAIKHLDKVRLTVGGPAAVTEARFSQ<br>DYLQMVAAVFNGSVQNPKPRRRDDGDAWHKPPKPATAQSQP<br>DQKPPNKAPSAGSRLPPPQVGEVYEGVVVKVIDTGSLGFFA<br>VEGVAGNIGLHISRLRRIREDAIIVGRRYRFRVEIYVPPKS<br>NTSKLNAADLVRID |
| c2c2-15 | 16 | *Rhodobacter*<br>*capsulatus*<br>R121 (SEQ<br>ID No. 44) | MQIGKVQGRTISEFGDPAGGLKRKISTDGKNRKELPAHLSS<br>DPKALIGQWISGIDKIYRKPDSRKSDGKAIHSPTPSKMQFD<br>ARDDLGEAFWKLVSEAGLAQSDYDQFKRRLHPYGDKFQPA<br>DSGAKLKFEADPPEPQAFHGRWYGAMSKRGNDAKELAAALY<br>EHLHVDEKRIDGQPKRNPKTDKFAPGLVVARALGIESSVLP<br>RGMARLARNWGEEEIQTYFVVDVAASVKEVAKAAVSAAQAF<br>DPPRQVSGRSLSPKVGFALAEHLERVTGSKRCSFDPAAGPS<br>VLALHDEVKKTYKRLCARGKNAARAFPADKTELLALMRHTH<br>ENRVRNQMVRMGRVSEYRGQQAGDLAQSHYWTSAGQTEIKE<br>SEIFVRLWVGAFALAGRSMKAWIDPMGKIVNTEKNDRDLTA<br>AVNIRQVISNKEMVAEAMARRGIYFGETPELDRLGAEGNEG<br>FVFALLRYLRGCRNQTFHLGARAGFLKEIRKELEKTRWGKA<br>KEAEHVVLTDKTVAAIRAIIDNDAKALGARLLADLSGAFVA<br>HYASKEHFSTLYSEIVKAVKDAPEVSSGLPRLKLLLKRADG |

TABLE 2-continued

| | | |
|---|---|---|
| | | VRGYVHGLRDTRKHAFATKLPPPPAPRELDDPATKARYIAL
LRLYDGPFRAYASGITGTALAGPAARAKEAATALAQSVNVT
KAYSDVMEGRSSRLRPPNDGETLREYLSALTGETATEFRVQ
IGYESDSENARKQAEFIENYRRDMLAFMFEDYIRAKGFDWI
LKIEPGATAMTRAPVLPEPIDTRGQYEHWQAALYLVMHFVP
ASDVSNLLHQLRKWEALQGKYELVQDGDATDQADRREALD
LVKRFRDVLVLFLKTGEARFEGRAAPFDLKPFRALFANPAT
FDRLFMATPTTARPAEDDPEGDGASEPELRVARTLRGLRQI
ARYNHMAVLSDLFAKHKVRDEEVARLAEIEDETQEKSQIVA
AQELRTDLHDKVMKCHPKTISPEERQSYAAAIKTIEEHRFL
VGRVYLGDHLRLHRLMMDVIGRLIDYAGAYERDTGTFLINA
SKQLGAGADWAVTIAGAANTDARTQTRKDLAHFNVLDRADG
TPDLTALVNRAREMMAYDRKRKNAVPRSILDMLARLGLTLK
WQMKDHLLQDATITQAAIKHLDKVRLTVGGPAAVTEARFSQ
DYLQMVAAVFNGSVQNPKPRRDDGDAWHKPPKPATAQSQP
DQKPPNKAPSAGSRLPPPQVGEVYEGVVVKVIDTGSLGFLA
VEGVAGNIGLHISRLRRIREDAIIVGRRYRFRVEIYVPPKS
NTSKLNAADLVRID |
| c2c2-16 | 17 *Rhodobacter capsulatus* DE442 (SEQ ID No. 45) | MQIGKVQGRTISEFGDPAGGLKRKISTDGKNRKELPAHLSS
DPKALIGQWISGIDKIYRKPDSRKSDGKAIHSPTPSKMQFD
ARDDLGEAFWKLVSEAGLAQDSDYDQFKRRLHPYGDKFQPA
DSGAKLKFEADPPEPQAFHGRWYGAMSKRGNDAKELAAALY
EHLHVDEKRIDGQPKRNPKTDKFAPGLVVARALGIESSVLP
RGMARLARNWGEEEIQTYFVVDVAASVKEVAKAAVSAAQAF
DPPRQVSGRSLSPKVGFALAEHLERVTGSKRCSFDPAAGPS
VLALHDEVKKTYKRLCARGKNAARAFPADKTELLALMRHTH
ENRVRNQMVRMGRVSEYRGQQAGDLAQSHYWTSAGQTEIKE
SEIFVRLWVGAFALAGRSMKAWIDPMGKIVNTEKNDRDLTA
AVNIRQVISNKEMVAEAMARRGIYFGETPELDRLGAEGNEG
FVFALLRYLRGCRNQTFHLGARAGFLKEIRKELEKTRWGKA
KEAEHVVLTDKTVAAIRAIIDNDAKALGARLLADLSGAFVA
HYASKEHFSTLYSEIVKAVKDAPEVSSGLPRLKLLLKRADG
VRGYVHGLRDTRKHAFATKLPPPPAPRELDDPATKARYIAL
LRLYDGPFRAYASGITGTALAGPAARAKEAATALAQSVNVT
KAYSDVMEGRSSRLRPPNDGETLREYLSALTGETATEFRVQ
IGYESDSENARKQAEFIENYRRDMLAFMFEDYIRAKGFDWI
LKIEPGATAMTRAPVLPEPIDTRGQYEHWQAALYLVMHFVP
ASDVSNLLHQLRKWEALQGKYELVQDGDATDQADRREALD
LVKRFRDVLVLFLKTGEARFEGRAAPFDLKPFRALFANPAT
FDRLFMATPTTARPAEDDPEGDGASEPELRVARTLRGLRQI
ARYNHMAVLSDLFAKHKVRDEEVARLAEIEDETQEKSQIVA
AQELRTDLHDKVMKCHPKTISPEERQSYAAAIKTIEEHRFL
VGRVYLGDHLRLHRLMMDVIGRLIDYAGAYERDTGTFLINA
SKQLGAGADWAVTIAGAANTDARTQTRKDLAHFNVLDRADG
TPDLTALVNRAREMMAYDRKRKNAVPRSILDMLARLGLTLK
WQMKDHLLQDATITQAAIKHLDKVRLTVGGPAAVTEARFSQ
DYLQMVAAVFNGSVQNPKPRRDDGDAWHKPPKPATAQSQP
DQKPPNKAPSAGSRLPPPQVGEVYEGVVVKVIDTGSLGFLA
VEGVAGNIGLHISRLRRIREDAIIVGRRYRFRVEIYVPPKS
NTSKLNAADLVRID |
| c2c2-2 | (SEQ ID No. 46) | MGNLFGHKRWYEVRDKKDFKIKRKVKVKRNYDGNKYILNIN
ENNNKEKIDNNKFIRKYINYKKNDNILKEFTRKFHAGNILF
KLKGKEGIIRIENNDDFLETEEVVLYIEAYGKSEKLKALGI
TKKKIIDEAIRQGITKDDKKIEIKRQENEEEIEIDIRDEYT
NKTLNDCSIILRIIENDELETKKSIYEIFKNINMSLYKIIE
KIIENETEKVFENRYYEEHLREKLLKDDKIDVILTNFMEIR
EKIKSNLEILGFVKFYLNVGGDKKKSKNKKMLVEKILNINV
DLTVEDIADFVIKELEFWNITKRIEKVKKVNNEFLEKRRNR
TYIKSYVLLDKHEKFKIERENKKDKIVKFFVENIKNNSIKE
KIEKILAEFKIDELIKKLEKELKKGNCDTEIFGIFKKHYKV
NFDSKKFSKKSDEEKELYKIIYRYLKGRIEKILVNEQKVRL
KKMEKIEIEKILNESILSEKILKRVKQYTLEHIMYLGKLRH
NDIDMTTVNTDDFSRLHAKEELDLELITFFASTNMELNKIF
SRENINNDENIDFFGGDREKNYVLDKKILNSKIKIIRDLDF
IDNKNNITNNFIRKFTKIGTNERNRILHAISKERDLQGTQD
DYNKVINIIQNLKISDEEVSKALNLDVVFKDKKNIITKIND
IKISEENNNDIKYLPSFSKVLPEILNLYRNNPKNEPFDTIE
TEKIVLNALIYVNKELYKKILEDDLEENESKNIFLQELKK
TLGNIDEIDENIIENYYKNAQISASKGNNKAIKKYQKKVIE
CYIGYLRKNYEELFDFSDFKMNIQEIKKQIKDINDNKTYER
ITVKTSDKTIVINDDFEYIISIFALLNSNAVINKIRNRFFA
TSVWLNTSEYQNIIDILDEIMQLNTLRNECITENWNLNLEE
FIQKMKEIEKDFDDFKIQTKKEIFNNYYEDIKNNILTEFKD
DINGCDVLEKKLEKIVIFDDETKFEIDKKSNILQDEQRKLS
NINKKDLKKKVDQYIKDKDQEIKSKILCRIIFNSDFLKKYK
KEIDNLIEDMESENENKFQEIYYPKERKNELYIYKKNLFLN
IGNPNFDKIYGLISNDIKMADAKFLFNIDGKNIRKNKISEI
DAILKNLNDKLNGYSKEYKEKYIKKLKENDDFFAKNIQNKN |

TABLE 2-continued

| | | |
|---|---|---|
| | | YKSFEKDYNRVSEYKKIRDLVEFNYLNKIESYLIDINWKLA<br>IQMARFERDMHYIVNGLRELGIIKLSGYNTGISRAYPKRNG<br>SDGFYTTTAYYKFFDEESYKKFEKICYGFGIDLSENSEINK<br>PENESIRNYISHFYIVRNPFADYSIAEQIDRVSNLLSYSTR<br>YNNSTYASVFEVFKKDVNLDYDELKKKFKLIGNNDILERLM<br>KPKKVSVLELESYNSDYIKNLIIELLTKIENTNDTL |
| c2c2-3 | L wadei<br>(Lw2)<br>(SEQ ID<br>No. 47) | MKVTKVDGISHKKYIEEGKLVKSTSEENRTSERLSELLSIR<br>LDIYIKNPDNASEEENRIRRENLKKFFSNKVLHLKDSVLYL<br>KNRKEKNAVQDKNYSEEDISEYDLKNKNSFSVLKKILLNED<br>VNSEELEIFRKDVEAKLNKINSLKYSFEENKANYQKINENN<br>VEKVGGKSKRNIIYDYYRESAKRNDYINNVQEAFDKLYKKE<br>DIEKLFFLIENSKKHEKYKIREYYHKIIGRKNDKENFAKII<br>YEEIQNVNNIKELIEKIPDMSELKKSQVFYKYYLDKEELND<br>KNIKYAFCHFVEIEMSQLLKNYVYKRLSNISNDKIKRIFEY<br>QNLKKLIENKLLNKLDTYVRNCGKYNYYLQVGEIATSDFIA<br>RNRQNEAFLRNIIGVSSVAYFSLRNILETENENDITGRMRG<br>KTVKNNKGEEKYVSGEVDKIYNENKQNEVKENLKMFYSYDF<br>NMDNKNEIEDFFANIDEAISSIRHGIVHFNLELEGKDIFAF<br>KNIAPSEISKKMFQNEINEKKLKLKIFKQLNSANVFNYYEK<br>DVIIKYLKNTKFNFVNKNIPFVPSFTKLYNKIEDLRNTLKF<br>FWSVPKDKEEKDAQIYLLKNIYYGEFLNKFVKNSKVFFKIT<br>NEVIKINKQRNQKTGHYKYQKFENIEKTVPVEYLAIIQSRE<br>MINNQDKEEKNTYIDFIQQIFLKGFIDYLNKNNLKYIESNN<br>NNDNNDIFSKIKIKKDNKEKYDKILKNYEKHNRNKEIPHEI<br>NEFVREIKLGKILKYTENLNMFYLILKLLNHKELTNLKGSL<br>EKYQSANKEETFSDELELINLLNLDNNRVTEDFELEANEIG<br>KFLDFNENKIKDRKELKKFDTNKIYFDGENIIKHRAFYNIK<br>KYGMLNLLEKIADKAKYKISLKELKEYSNKKNEIEKNYTMQ<br>QNLHRKYARPKKDEKFNDEDYKEYEKAIGNIQKYTHLKNKV<br>EFNELNLLQGLLLKILHRLVGYTSIWERDLRFRLKGEFPEN<br>HYIEEIFNFDNSKNVKYKSGQIVEKYINFYKELYKDNVEKR<br>SIYSDKKVKKLKQEKKDLYIRNYIAHFNYIPHAEISLLEVL<br>ENLRKLLSYDRKLKNAIMKSIVDILKEYGFVATFKIGADKK<br>IEIQTLESEKIVHLKNLKKKKLMTDRNSEELCELVKVMFEY<br>KALEKRPAATKKAGQAKKKKGSYPDVPDYAYPYDVPDYAY<br>PYDVPDYA* |
| c2c2-4 | Listeria<br>seeligeri<br>(SEQ ID<br>No. 48) | MWISIKTLIHHLGVLFFCDYMYNRREKKIIEVKTMRITKVE<br>VDRKKVLISRDKNGGKLVYENEMQDNTEQIMHHKKSSFYKS<br>VVNKTICRPEQKQMKKLVHGLLQENSQEKIKVSDVTKLNIS<br>NFLNHRFKKSLYYFPENSPDKSEEYRIEINLSQLLEDSLKK<br>QQGTFICWESFSKDMELYINWAENYISSKTKLIKKSIRNNR<br>IQSTESRSGQLMDRYMKDILNKNKPFDIQSVSEKYQLEKLT<br>SALKATFKEAKKNDKEINYKLKSTLQNHERQIIEEELKENSE<br>LNQFNIEIRKHLETYFPIKKTNRKVGDIRNLEIGEIQKIVN<br>HRLKNKIVQRILQEGKLASYEIESTVNSNSLQKIKIEEAFA<br>LKFINACLFASNNLRNMVYPVCKKDILMIGEFKNSFKEIKH<br>KKFIRQWSQFFSQEITVDDIELASWGLRGAIAPIRNEIIHL<br>KKHSWKKFFNNPTFKVKKSKIINGKTKDVTSEFLYKETLFK<br>DYFYSELDSVPELIINKMESSKILDYYSSDQLNQVFTIPNF<br>ELSLLTSAVPFAPSFKRVYLKGFDYQNQDEAQPDYNLKLNI<br>YNEKAFNSEAFQAQYSLFKMVYYQVFLPQFTTNNDLFKSSV<br>DFILTLNKERKGYAKAFQDIRKMNKDEKPSEYMSYIQSQLM<br>LYQKKQEEKEKINHFEKFINQVFIKGFNSFIEKNRLTYICH<br>PTKNTVPENDNIEIPFHTDMDDSNIAFWLMCKLLDAKQLSE<br>LRNEMIKFSCSLQSTEEISTFTKAREVIGLALLNGEKGCND<br>WKELFDDKEAWKKNMSLYVSEELLQSLPYTQEDGQTPVINR<br>SIDLVKKYGTETILEKLFSSSDDYKVSAKDIAKLHEYDVTE<br>KIAQQESLHKQWIEKPGLARDSAWTKKYQNVINDISNYQWA<br>KTKVELTQVRHLHQLTIDLLSRLAGYMSIADRDFQFSSNYI<br>LERENSEYRVTSWILLSENKNKNKYNDYELYNLKNASIKVS<br>SKNDPQLKVDLKQLRLTLEYLELFDNRLKEKRNNISHFNYL<br>NGQLGNSILELFDDARDVLSYDRKLKNAVSKSLKEILSSHG<br>MEVTFKPLYQTNHHLKIDKLQPKKIHHLGEKSTVSSNQVSN<br>EYCQLVRTLLTMK |
| C2-17 | Leptotrichia<br>buccalis<br>C-1013-b<br>(SEQ ID<br>No. 49) | MKVTKVGGISHKKYTSEGRLVKSESEENRTDERLSALLNMR<br>LDMYIKNPSSTETKENQKRIGKLKKFFSNKMVYLKDNTLSL<br>KNGKKENIDREYSETDILESDVRDKKNFAVLKKIYLNENVN<br>SEELEVFRNDIKKKLNKINSLKYSFEKNKANYQKINENNIE<br>KVEGKSKRNIIYDYYRESAKRDAYVSNVKEAFDKLYKEEDI<br>AKLVLEIENLTKLEKYKIREFYHEIIGRKNDKENFAKIIYE<br>EIQNVNNMKELIEKVPDMSELKKSQVFYKYYLDKEELNDKN<br>IKYAFCHFVEIEMSQLLKNYVYKRLSNISNDKIKRIFEYQN<br>LKKLIENKLLNKLDTYVRNCGKYNYYLQDGEIATSDFIARN<br>RQNEAFLRNIIGVSSVAYFSLRNILETENENDITGRMRGKT<br>VKNNKGEEKYVSGEVDKIYNENKKNEVKENLKMFYSYDFNM<br>DNKNEIEDFFANIDEAISSIRHGIVHFNLELEGKDIFAFKN<br>IAPSEISKKMFQNEINEKKLKLKIFRQLNSANVFRYLEKYK |

TABLE 2-continued

| | | |
|---|---|---|
| | | ILNYLKRTRFEFVNKNIPFVPSFTKLYSRIDDLKNSLGIYW
KTPKTNDDNKTKEIIDAQIYLLKNIYYGEFLNYFMSNNGNF
FEISKEIIELNKNDKRNLKTGFYKLQKFEDIQEKIPKEYLA
NIQSLYMINAGNQDEEEKDTYIDFIQKIFLKGFMTYLANNG
RLSLIYIGSDEETNTSLAEKKQEFDKFLKKYEQNNNIKIPY
EINEFLREIKLGNILKYTERLNMFYLILKLLNHKELTNLKG
SLEKYQSANKEEAFSDQLELINLLNLDNNRVTEDFELEADE
IGKFLDFNGNKVKDNKELKKFDTNKIYFDGENIIKHRAFYN
IKKYGMLNLLEKIADKAGYKISIEELKKYSNKKNEIEKNHK
MQENLHRKYARPRKDEKFTDEDYESYKQAIENIEEYTHLKN
KVEFNELNLLQGLLLRILHRLVGYTSIWERDLRFRLKGEFP
ENQYIEEIFNFENKKNVKYKGGQIVEKYIKFYKELHQNDEV
KINKYSSANIKVLKQEKKDLYIRNYIAHFNYIPHAEISLLE
VLENLRKLLSYDRKLKNAVMKSVVDILKEYGFVATFKIGAD
KKIGIQTLESEKIVHLKNLKKKKLMTDRNSEELCKLVKIMF
EYKMEEKKSEN |
| C2-18 | *Herbinix
hemi-
cellulosilytica*
(SEQ ID
No. 50) | MKLTRRRISGNSVDQKITAAFYRDMSQGLLYYDSEDNDCTD
KVIESMDFERSWRGRILKNGEDDKNPFYMFVKGLVGSNDKI
VCEPIDVDSDPDNLDILINKNLTGFGRNLKAPDSNDTLENL
IRKIQAGIPEEEVLPELKKIKEMIQKDIVNRKEQLLKSIKN
NRIPFSLEGSKLVPSTKKMKWLFKLIDVPNKTFNEKMLEKY
WEIYDYDKLKANITNRLDKTDKKARSISRAVSEELREYHKN
LRTNYNRFVSGDRPAAGLDNGGSAKYNPDKEEFLLFLKEVE
QYFKKYFPVKSKHSNKSKDSLVDKYKNYCSYKVVKKEVNR
SIINQLVAGLIQQGKLLYYFYYNDTWQEDFLNSYGLSYIQV
EEAPKKSVMTSLSWGINRLTSFFIDDSNTVKFDDITTKKAK
EAIESNYFNKLRTCSRMQDHFKEKLAFFYPVYVKDKKDRPD
DDIENLIVLVKNAIESVSYLRNRTFHFKESSLLELLKELDD
KNSGQNKIDYSVAAEFIKRDIENLYDVFREQIRSLGIAEYY
KADMISDCFKTCGLEFALYSPKNSLMPAFKNVYKRGANLNK
AYIRDKGPKETGDQGQNSYKALEEYRELTWYIEVKNNDQSY
NAYKNLLQLIYYHAFLPEVRENEALITDPINRTKEWNRKET
EERLNTKNNKKHKNFDENDDITVNTYRYESIPDYQGESLDD
YLKVLQRKQMARAKEVNEKEEGNNNYIQPIRDVVVWAFGAY
LENKLKNYKNELQPPLSKENIGLNDTLKELFPEEKVKSPFN
IKCRFSISTFIDNKGKSTDNTSAEAVKTDGKEDEKDKKNIK
RKDLLCFYLFLRLLDENEICKLQHQFIKYRCSLKERRFPGN
RTKLEKETELLAELEELMELVRFTMPSIPEISAKAESGYDT
MIKKYFKDFIEKKVFKNPKTSNLYYHSDSKTPVTRKYMALL
MRSAPLHLYKDIFKGYYLITKKECLEYIKLSNIIKDYQNSL
NELHEQLERIKLKSEKQNGKDSLYLDKKDFYKVKEYVENLE
QVARYKHLQHKINFESLYRIFRIHVDIAARMVGYTQDWERD
MHFLFKALVYNGVLEERRFEAIFNNNDDNNDGRIVKKIQNN
LNNKNRELVSMLCWNKKLNKNEFGAIIWKRNPIAHLNHFTQ
TEQNSKSSLESLINSLRILLAYDRKRQNAVTKTINDLLLND
YHIRIKWEGRVDEGQIYFNIKEKEDIENEPIIHLKHLHKKD
CYIYKNSYMFDKQKEWICNGIKEEVYDKSILKCIGNLFKFD
YEDKNKSSANPKHT |
| C2-19 | [*Eubacterium*]
*rectale*
(SEQ ID
No. 51) | MLRRDKEVKKLYNVFNQIQVGTKPKKWNNDEKLSPEENERR
AQQKNIKMKNYKWREACSKYVESSQRIINDVIFYSYRKAKN
KLRYMRKNEDILKKMQEAEKLSKFSGGKLEDFVAYTLRKSL
VVSKYDTQEFDSLAAMVVFLECIGKNNISDHEREIVCKLLE
LIRKDFSKLDPNVKGSQGANIVRSVRNQNMIVQPQGDRFLF
PQVYAKENETVTNKNVEKEGLNEFLLNYANLDDEKRAESLR
KLRRILDVYFSAPNHYEKDMDITLSDNIEKEKFNVWEKHEC
GKKETGLFVDIPDVLMEAEAENIKLDAVVEKRERKVLNDRV
RKQNIICYRYTRAVVEKYNSNEPLFFENNAINQYWIHHHIEN
AVERILKNCKAGKLFKLRKGYLAEKVWKDAINLISIKYIAL
GKAVYNFALDDIWKDKKNKELGIVDERIRNGITSFDYEMIK
AHENLQRELAVDIAFSVNNLARAVCDMSNLGNKESDFLLWK
RNDIADKLKNKDDMASVSAVLQFFGGKSSWDINIFKDAYKG
KKKYNYEVRFIDDLRKAIYCARNENFHFKTALVNDEKWNTE
LFGKIFERETEFCLNVEKDRFYSNNLYMFYQVSELRNMLDH
LYSRSVSRAAQVPSYNSVIVRTAFPEYITNVLGYQKPSYDA
DTLGKWYSACYYLLKEIYYNSFLQSDRALQLFEKSVKTLSW
DDKKQQRAVDNFKDHFSDIKSACTSLAQVCQIYMTEYNQQN
NQIKKVRSSNDSIFDQPVYQHYKVLLKKAIANAFADYLKNN
KDLFGFIGKPFKANEIREIDKEQFLPDWTSRKYEALCIEVS
GSQELQKWYIVGKFLNARSLNLMVGSMRSYIQYVTDIKRRA
ASIGNELHVSVHDVEKVEKWVQVIEVCSLLASRTSNQFEDY
FNDKDDYARYLKSYVDFSNVDMPSEYSALVDFSNEEQSDLY
VDPKNPKVNRNIVHSKLFAADHILRDIVEPVSKDNIEEFYS
QKAEIAYCKIKGKEITAEEQKAVLKYQKNRVELRDIVEY
GEIINELLGQLINWSFMRERDLLYFQLGFHYDCLRNDSKKP
EGYKNIKVDENSIKDAILYQIIGMYVNGVTVYAPEKDGDKL
KEQCVKGGVGVKVSAFHRYSKYLGLNEKTLYNAGLEIFEVV
AEHEDIINLRNGIDHFKYYLGDYRSMLSIYSEVFDRFFTYD
IKYQKNVLNLLQNILLRHNVIVEPILESGFKTIGEQTKPGA |

TABLE 2-continued

| | | |
|---|---|---|
| | | KLSIRSIKSDTFQYKVKGGTLITDAKDERYLETIRKILYYA<br>ENEEDNLKKSVVVTNADKYEKNKESDDQNKQKEKKNKDNKG<br>KKNEETKSDAEKNNNERLSYNPFANLNFKLSN |
| C2-20 | Eubacteriaceae<br>bacterium<br>CHKCI004<br>(SEQ ID<br>No. 52) | MKISKESHKRTAVAVMEDRVGGVVYVPGGSGIDLSNNLKKR<br>SMDTKSLYNVFNQIQAGTAPSEYEWKDYLSEAENKKREAQK<br>MIQKANYELRRECEDYAKKANLAVSRIIFSKKPKKIFSDDD<br>IISHMKKQRLSKFKGRMEDFVLIALRKSLVVSTYNQEVFDS<br>RKAATVFLKNIGKKNISADDERQIKQLMALIREDYDKWNPD<br>KDSSDKKESSGTKVIRSIEHQNMVIQPEKNKLSLSKISNVG<br>KKTKTKQKEKAGLDAFLKEYAQIDENSRMEYLKKLRRLLDT<br>YFAAPSSYIKGAAVSLPENINFSSELNVWERHEAAKKVNIN<br>FVEIPESLLNAEQNNNKINKVEQEHSLEQLRTDIRRRNITC<br>YHFANALAADERYHTLFFENMAMNQFWIHHMENAVERILKK<br>CNVGTLFKLRIGYLSEKVWKDMLNLLSIKYIALGKAVYHFA<br>LDDIWKADIWKDASDKNSGKINDLTLKGISSFDYEMVKAQE<br>DLQREMAVGVAFSTNNLARVTCKMDDLSDAESDFLLWNKEA<br>IRRHVKYTEKGEILSAILQFFGGRSLWDESLFEKAYSDSNY<br>ELKFLDDLKRAIYAARNETFHFKTAAIDGGSWNTRLFGSLF<br>EKEAGLCLNVEKNKFYSNNLVLFYKQEDLRVFLDKLYGKEC<br>SRAAQIPSYNTILPRKSFSDFMKQLLGLKEPVYGSAILDQW<br>YSACYYLFKEVYYNLFLQDSSAKALFEKAVKALKGADKKQE<br>KAVESFRKRYWEISKNASLAEICQSYITEYNQQNNKERKVR<br>SANDGMFNEPIYQHYKMLLKEALKMAFASYIKNDKELKFVY<br>KPTEKLFEVSQDNFLPNWNSEKYNTLISEVKNSPDLQKWYI<br>VGKFMNARMLNLLLGSMRSYLQYVSDIQKRAAGLGENQLHL<br>SAENVGQVKKWIQVLEVCLLLSVRISDKFTDYFKDEEEYAS<br>YLKEYVDFEDSAMPSDYSALLAFSNEGKIDLYVDASNPKVN<br>RNIIQAKLYAPDMVLKKVVKKISQDECKEFNEKKEQIMQFK<br>NKGDEVSWEEQQKILEYQKLKNRVELRDLSEYGELINELLG<br>QLINWSYLRERDLLYFQLGFHYSCLMNESKKPDAYKTIRRG<br>TVSIENAVLYQIIAMYINGFPVYAPEKGELKPQCKTGSAGQ<br>KIRAFCQWASMVEKKKYELYNAGLELFEVVKEHDNIIDLRN<br>KIDHFKYYQGNDSILALYGEIFDRFFTYDMKYRNNVLNHLQ<br>NILLRHNVIIKPIISKDKKEVGRGKMKDRAAFLLEEVSSDR<br>FTYKVKEGERKIDAKNRLYLETVRDILYFPNRAVNDKGEDV<br>IICSKKAQDLNEKKADRDKNHDKSKDTNQKKEGKNQEEKSE<br>NKEPYSDRMTWKPFAGIKLE |
| C2-21 | Blautia sp.<br>Marseille-<br>P2398<br>(SEQ ID<br>No. 53) | MKISKVDHVKSGIDQKLSSQRGMLYKQPQKKYEGKQLEEHV<br>RNLSRKAKALYQVFPVSGNSKMEKELQIINSFIKNILLRLD<br>SGKTSEEIVGYINTYSVASQISGDHIQELVDQHLKESLRKY<br>TCVGDKRIYVPDIIVALLKSKFNSETLQYDNSELKILIDFI<br>REDYLKEKQIKQIVHSIENNSTPLRIAEINGQKRLIPANVD<br>NPKKSYIFEFLKEYAQSDPKGQESLLQHMRYLILLYLYGPD<br>KITDDYCEEIEAWNFGSIVMDNEQLFSEEASMLIQDRIYVN<br>QQIEEGRQSKDTAKVKKNKSKYRMLGDKIEHSINESVVKHY<br>QEACKAVEEKDIPWIKYISDHVMSVYSSKNRVDLDKLSLPY<br>LAKNTWNTWISFIAMKYVDMGKGVYHFAMSDVDKVGKQDNL<br>IIGQIDPKFSDGISSFDYERIKAEDDLHRSMSGYIAFAVNN<br>FARAICSDEFRKKNRKEDVLTVGLDEIPLYDNVKRKLLQYF<br>GGASNWDDSIIDIIDDKDLVACIKENLYVARNVNFHFAGSE<br>KVQKKQDDILEEIVRKETRDIGKHYRKVFYSNNVAVFYCDE<br>DIIKLMNHLYQREKPYQAQIPSYNKVISKTYLPDLIFMLLK<br>GKNRTKISDPSIMNMFRGTFYFLLKEIYYNDFLQASNLKEM<br>FCEGLKNNVKNKKSEKPYQNFMRRFEELENMGMDFGEICQQ<br>IMTDYEQQNKQKKKTATAVMSEKDKKIRTLDNDTQKYKHFR<br>TLLYIGLREAFIIYLKDEKNKEWYEFLREPVKREQPEEKEF<br>VNKWKLNQYSDCSELILKDSLAAAWYVVAHFINQAQLNHLI<br>GDIKNYIQFISDIDRRAKSTGNPVSESTEIQIERYRKILRV<br>LEFAKFFCGQITNVLTDYYQDENDFSTHVGHYVKFEKKNME<br>PAHALQAFSNSLYACGKEKKKAGFYYDGMNPIVNRNITLAS<br>MYGNKKLLENAMNPVTEQDIRKYYSLMAELDSVLKNGAVCK<br>SEDEQKNLRHFQNLKNRIELVDVLTLSELVNDLVAQLIGWV<br>YIRERDMMYLQLGLHYIKLYFTDSVAEDSYLRTLDLEEGSI<br>ADGAVLYQIASLYSFNLPMYVKPNKSSVYCKKHVNSVATKF<br>DIFEKEYCNGDETVIENGLRLFENINLHKDMVKFRDYLAHF<br>KYFAKLDESILELYSKAYDFFFSYNIKLKKSVSYVLTNVLL<br>SYFINAKLSFSTYKSSGNKTVQHRTTKISVVAQTDYFTYKL<br>RSIVKNKNGVESIENDDRRCEVVNIAARDKEFVDECVNVIN<br>YNSDK |
| C2-22 | Leptotrichia<br>sp. oral<br>taxon 879<br>str. F0557<br>(SEQ ID<br>No. 54) | MGNLFGHKRWYEVRDKKDFKIKRKVKVKRNYDGNKYILNIN<br>ENNNKEKIDNNKFIGEFVNYKKNNNVLKEFKRKFHAGNILF<br>KLKGKEEIIRIENNDDFLETEEVVLYIEVYGKSEKLKALEI<br>TKKKIIDEAIRQGITKDDKKIEIKRQENEEEIEIDIRDEYT<br>NKTLNDCSIILRIIENDELETKKSIYEIFKNINMSLYKIIE<br>KIIENETEKVFENRYYEEHLREKLLKDNKIDVILTNFMEIR<br>EKIKSNLEIMGFVKFYLNVSGDKKKSENKKMFVEKILNTNV<br>DLTVEDIVDFIVKELKFWNITKRIEKVKKFNNEFLENRRNR |

TABLE 2-continued

| | | |
|---|---|---|
| | | TYIKSYVLLDKHEKFKIERENKKDKIVKFFVENIKNNSIKE
KIEKILAEFKINELIKKLEKELKKGNCDTEIFGIFKKHYKV
NFDSKKFSNKSDEEKELYKIIYRYLKGRIEKILVNEQKVRL
KKMEKIEIEKILNESILSEKILKRVKQYTLEHIMYLGKLRH
NDIVKMTVNTDDFSRLHAKEELDLELITFFASTNMELNKIF
NGKEKVTDPFGFNLNGQKITLKEKVPSFKLNILKKLNFINN
ENNIDEKLSHFYSFQKEGYLLRNKILHNSYGNIQETKNLKG
EYENVEKLIKELKVSDEEISKSLSLDVIFEGKVDIINKINS
LKIGEYKDKKYLPSFSKIVLEITRKFREINKDKLFDIESEK
IILNAVKYVNKILYEKITSNEENEFLKTLPDKLVKKSNNKK
ENKNLLSIEEYYKNAQVSSSKGDKKAIKKYQNKVTNAYLEY
LENTFTEIIDFSKFNLNYDEIKTKIEERKDNKSKIIIDSIS
TNINITNDIEYIISIFALLNSNTYINKIRNRFFATSVWLEK
QNGTKEYDYENIISILDEVLLINLLRENNITDILDLKNAII
DAKIVENDETYIKNYIFESNEEKLKKRLFCEELVDKEDIRK
IFEDENFKPKSFIKKNEIGNFKINFGILSNLECNSEVEAKK
IIGKNSKKLESFIQNIIDEYKSNIRTLFSSEFLEKYKEEID
NLVEDTESENKNKFEKIYYPKEHKNELYIYKKNLFLNIGNP
NFDKIYGLISKDIKNVDTKILFDDDIKKNKISEIDAILKNL
NDKLNGYSNDYKAKYVNKLKENDDFFAKNIQNENYSSFGEF
EKDYNKVSEYKIRDLVEFNYLNKIESYLIDINWKLAIQMA
RFERDMHYIVNGLRELGIIKLSGYNTGISRAYPKRNGSDGF
YTTTAYYKFFDEESYKKFEKICYGFGIDLSENSEINKPENE
SIRNYISHFYIVRNPFADYSIAEQIDRVSNLLSYSTRYNNS
TYASVFEVFKKDVNLDYDELKKKFRLIGNNDILERLMKPKK
VSVLELESYNSDYIKNLIIELLTKIENTNDTL |
| C2-23 | Lachnospiraceae
bacterium
NK4A144
(SEQ ID
No. 55) | MKISKVDHTRMAVAKGNQHRRDEISGILYKDPTKTGSIDFD
ERFKKLNCSAKILYHVFNGIAEGSNKYKNIVDKVNNNLDRV
LFTGKSYDRKSIIDIDTVLRNVEKINAFDRISTEEREQIID
DLLEIQLRKGLRKGKAGLREVLLIGAGVIVRTDKKQEIADF
LEILDEDFNKTNQAKNIKLSIENQGLVVSPVSRGEERIFDV
SGAQKGKSSKKAQEKEALSAFLLDYADLDKNVRFEYLRKIR
RLINLYFYVKNDDVMSLTEIPAEVNLEKDFDIWRDHEQRKE
ENGDFVGCPDILLADRDVKKSNSKQVKIAERQLRESIREKN
IKRYRFSIKTIEKDDGTYFFANKQISVFWIHRIENAVERIL
GSINDKKLYRLRLGYLGEKVWKDILNFLSIKYIAVGKAVFN
FAMDDLQEKDRDIEPGKISENAVNGLTSFDYEQIKADEMLQ
REVAVNVAFAANNLARVTVDIPQNGEKEDILLWNKSDIKKY
KKNSKKGILKSILQFFGGASTWNMKMFEIAYHDQPGDYEEN
YLYDIIQIIYSLRNKSFHFKTYDHGDKNWNRELIGKMIEHD
AERVISVEREKFHSNNLPMFYKDADLKKILDLLYSDYAGRA
SQVPAFNTVLVRKNFPEFLRKDMGYKVHFNNPEVENQWHSA
VYYLYKEIYYNLFLRDKEVKNLFYTSLKNIRSEVSDKKQKL
ASDDFASRCEEIEDRSLPEICQIIMTEYNAQNFGNRKVKSQ
RVIEKNKDIFRHYKMLLIKTLAGAFSLYLKQERFAFIGKAT
PIPYETTDVKNFLPEWKSGMYASFVEEIKNNLDLQEWYIVG
RFLNGRMLNQLAGSLRSYIQYAEDIERRAAENRNKLFSKPD
EKIEACKKAVRVLDLCIKISTRISAEFTDYFDSEDDYADYL
EKYLKYQDDAIKELSGSSYAALDHFCNKDDLKFDIYVNAGQ
KPILQRNIVMAKLFGPDNILSEVMEKVTESAIREYYDYLKK
VSGYRVRGKCSTEKEQEDLLKFQRLKNAVEFRDVTEYAEVI
NELLGQLISWSYLRERDLLYFQLGFHYMCLKNKSFKPAEYV
DIRRNNGTIIHNAILYQIVSMYINGLDFYSCDKEGKTLKPI
ETGKGVGSKIGQFIKYSQYLYNDPSYKLEIYNAGLEVFENI
DEHDNITDLRKYVDHFKYYAYGNKMSLLDLYSEFFDRFFTY
DMKYQKNVVNVLENILLRHFVIFYPKFGSGKKDVGIRDCKK
ERAQIEISEQSLTSEDFMFKLDDKAGEEAKKFPARDERYLQ
TIAKLLYYPNEIEDMNRFMKKGETINKKVQFNRKKKITRKQ
KNNSSNEVLSSTMGYLFKNIKL |
| C2-24 | Chloroflexus
aggregans
(SEQ ID
No. 56) | MTDQVRREEVAAGELADTPLAAAQTPAADAAVAATPAPAEA
VAPTPEQAVDQPATTGESEAPVTTAQAAAHEAEPAEATGAS
FTPVSEQQPQKPRRLKDLQPGMELEGKVTSIALYGIFVDVG
VGRDGLVHISEMSDRRIDTPSELVQIGDTVKVWVKSVDLDA
RRISLTMLNPSRGEKPRRSRQSQPAQPQPRRQEVDREKLAS
LKVGEIVEGVITGFAPFGAFADIGVGKDGLIHISELSEGRV
EKPEDAVKVGERYQFKVLEIDGEGTRISLSLRRAQRTQRMQ
QLEPGQIIEGTVSGIATFGAFVDIGVGRDGLVHISALAPHR
VAKVEDVVKVGDKVKVKVLGVDPQSKRISLTMRLEEEQPAT
TAGDEAAEPAEEVTPTRRGNLERFAAAAQTARERSERGERS
ERGERRERRERRPAQSSPDTYIVGEDDDESFEGNATIEDLL
TKFGGSSSRRDRDRRRRHEDDDDEEMERPSNRRQREAIRRT
LQQIGYDE |
| C2-25 | Demequina
aurantiaca
(SEQ ID
No. 57) | MDLTWHALLILFIVALLAGFLDTLAGGGGLLTVPALLLTGI
PPLQALGTNKLQSSFGTGMATYQVIRKKRVHWRDVRWPMVW
AFLGSAAGAVAVQFIDTDALLIIPVVLALVAAYFLFVPKS
HLPPPEPRMSDPAYEATLVPIIGAYDGAFGPGTGSLYALSG
VALRAKTLVQSTAIAKTLNFATNFAALLVFAFAGHMLWTVG |

TABLE 2-continued

| | | |
|---|---|---|
| | | AVMIAGQLIGAYAGSHMLFRVNPLVLRVLIVVMSLGMLIRV
LLD |
| C2-26 | *Thalassospira
sp.
T5L5-1*
(SEQ ID
No. 58) | MRIIKPYGRSHVEGVATQEPRRKLRLNSSPDISRDIPGFAQ
SHDALIIAQWISAIDKIATKPKPDKKPTQAQINLRTTLGDA
AWQHVMAENLLPAATDPAIREKLHLIWQSKIAPWGTARPQA
EKDGKPTPKGGWYERFCGVLSPEAITQNVARQIAKDIYDHL
HVAAKRKGREPAKQGESSNKPGKFKPDRKRGLIEERAESIA
KNALRPGSHAPCPWGPDDQATYEQAGDVAGQIYAAARDCLE
EKKRRSGNRNTSSVQYLPRDLAAKILYAQYGRVFGPDTTIK
AALDEQPSLFALHKAIKDCYHRLINDARKRDILRILPRNMA
ALFRLVRAQYDNRDINALIRLGKVIHYHASEQGKSEHHGIR
DYWPSQQDIQNSRFWGSDGQADIKRHEAFSRIWRHIIALAS
RTLHDWADPHSQKFSGENDDILLLAKDAIEDDVFKAGHYER
KCDVLFGAQASLFCGAEDFEKAILKQAITGTGNLRNATFHF
KGKVRFEKELQELTKDVPVEVQSAIAALWQKDAEGRTRQIA
ETLQAVLAGHFLTEEQNRHIFAALTAAMAQPGDVPLPRLRR
VLARHDSICQRGRILPLSPCPDRAKLEESPALTCQYTVLKM
LYDGPFRAWLAQQNSTILNHYIDSTIARTDKAARDMNGRKL
AQAEKDLITSRAADLPRLSVDEKMGDFLARLTAATATEMRV
QRGYQSDGENAQKQAAFIGQFECDVIGRAFADFLNQSGFDF
VLKLKADTPQPDAAQCDVTALIAPDDISVSPPQAWQQVLYF
ILHLVPVDDASHLLHQIRKWQVLEGKEKPAQIAHDVQSVLM
LYLDMHDAKFTGGAALHGIEKFAEFFAHAADFRAVFPPQSL
QDQDRSIPRRGLREIVRFGULPLLQHMSGTVQITHDNVVAW
QAARTAGATGMSPIARRQKQREELHALAVERTARFRNADLQ
NYMHALVDVIKHRQLSAQVTLSDQVRLHRLMMGVLGRLVDY
AGLWERDLYFVVLALLYHHGATPDDVFKGQGKKNLADGQVV
AALKPKNRKAAAPVGVFDDLDHYGIYQDDRQSIRNGLSHFN
MLRGGKAPDLSHWVNQTRSLVAHDRKLKNAVAKSVIEMLAR
EGFDLDWGIQTDRGQHILSHGKIRTRQAHFQKSRLHIVKK
SAKPDKNDTVKIRENLHGDAMVERVVQLFAAQVQKRYDITV
EKRLDHLFLKPQDQKGKNGIHTHNGWSKTEKKRRPSRENRK
GNHEN |
| C2-27 | SAMN044
87830_13920
[*Pseudo-
butyrivibrio
sp. OR37*]
(SEQ ID
No. 59) | MKFSKESHRKTAVGVTESNGIIGLLYKDPLNEKEKIEDVVN
QRANSTKRLFNLFGTEATSKDISRASKDLAKVVNKAIGNLK
GNKKFNKKEQITKGLNTKIIVEELKNVLKDEKKLIVNKDII
DEACSRLLKTSFRTAKTKQAVKMILTAVLIENTNLSKEDEA
FVHEYFVKKLVNEYNKTSVKKQIPVALSNQNMVIQPNSVNG
TLEISETKKSKETKTTEKDAFRAFLRDYATLDENRRHKMRL
CLRNLVNLYFYGETSVSKDDFDEWRDHEDKKQNDELFVKKI
VSIKTDRKGNVKEVLDVDATIDAIRTNNIACYRRALAYANE
NPDVFFSDTMLNKFWIHHVENEVERIYGHINNNTGDYKYQL
GYLSEKVWKGIINYLSIKYIAEGKAVYNYAMNALAKDNNSN
AFGKLDEKFVNGITSFEYERIKAEETLQRECAVNIAFAANH
LANATVDLNEKDSDFLLLKHEDNKDTLGAVARPNILRNILQ
FFGGKSRWNDFDFSGIDEIQLLDDLRKMIYSLRNSSEHEKT
ENIDNDSWNTKLIGDMEAYDENMAGNVQKDKMYSNNVPMEY
STSDIEKMLDRLYAEVHERASQVPSFNSVFVRKNFPDYLKN
DLKITSAFGVDDALKWQSAVYYVCKEIYYNDFLQNPETFTM
LKDYVQCLPIDIDKSMDQKLKSERNAHKNEKEAFATYCKEC
DSLSAICQMIMTEYNNQNKGNRKVISARTKDGDKLIYKHYK
MILFEALKNVETIYLEKNINTYGELKKPKLINNVPAIEEEL
PNYNGRQYETLVNRITEETELQKWYIVGRLLNPKQVNQLIG
NERSYVQYVNDVARRAKQTGNNLSNDNIAWDVKNIIQIFDV
CTKLNGVTSNILEDYFDDGDDYARYLKNFVDYTNKNNDHSA
TLLGDFCAKEIDGIKIGIYHDGTNPIVNRNIIQCKLYGATG
IISDLTKDGSILSVDYEIIKKYMQMQKEIKVYQQKGICKTK
EEQQNLKKYQELKNIVELRNIIDYSEILDELQGQLINWGYL
RERDLMYEQLGEHYLCLHNESKKPVGYNNAGDISGAVLYQI
VAMYTNGLSLIDANGKSKKNAKASAGAKVGSFCSYSKEIRG
VDKDTKEDDDPIYLAGVELFENINEHQQCINLRNYIEHFHY
YAKHDRSMLDLYSEVFDREFTYDMKYTKNVPNMMYNILLQH
LVVPAFEFGSSEKRLDDNDEQTKPRAMFTLREKNGLSSEQF
TYRLGDGNSTVKLSARGDDYLRAVASLLYYPDRAPEGLIRD
AEAEDKFAKINHSNPKSDNRNNRGNFKNPKVQWYNNKTKRK |
| C2-28 | SAMN029
10398_00008
[*Butyrivibrio
sp.
YAB3001*]
(SEQ ID
No. 60) | MKISKVDHRKTAVKITDNKGAEGFIYQDPTRDSSTMEQIIS
NRARSSKVLENIFGDTKKSKDLNKYTESLIIYVNKAIKSLK
GDKRNNKYEEITESLKTERVLNALIQAGNEFTCSENNIEDA
LNKYLKKSFRVGNTKSALKKLLMAAYCGYKLSIEEKEEIQN
YFVDKLVKEYNKDTVLKYTAKSLKHQNMVVQPDTDNHVFLP
SRIAGATQNKMSEKEALTEFLKAYAVLDEEKRHNLRIIILRK
LVNLYFYESPDFIYPENNEWKEHDDRKNKTETFVSPVKVNE
EKNGKTFVKIDVPATKDLIRLKNIECYRRSVAETAGNPITY
FTDHNISKFWIHHIENEVEKIFALLKSNWKDYQFSVGYISE
KVWKEIINYLSIKYIAIGKAVYNYALEDIKKNDGTLNFGVI
DPSFYDGINSFEYEKIKAEETEQREVAVYVSFAVNHLSSAT
VKLSEAQSDMLVLNKNDIEKIAYGNTKRNILQFFGGQSKWK |

TABLE 2-continued

| | | |
|---|---|---|
| | | EFDFDRYINPVNYTDIDFLFDIKKMVYSLRNESFHFTTTDT<br>ESDWNKNLISAMFEYECRRISTVQKNKFFSNNLPLFYGENS<br>LERVLHKLYDDYVDRMSQVPSFGNVFVRKKFPDYMKEIGIK<br>HNLSSEDNLKLQGALYFLYKEIYYNAFISSEKAMKIFVDLV<br>NKLDTNARDDKGRITHEAMAHKNFKDAISHYMTHDCSLADI<br>CQKIMTEYNQQNTGHRKKQTTYSSEKNPEIFRHYKMILFML<br>LQKAMTEYISSEEIFDFIMKPNSPKTDIKEEEFLPQYKSCA<br>YDNLIKLIADNVELQKWYITARLLSPREVNQLIGSFRSYKQ<br>FVSDIERRAKETNNSLSKSGMTVDVENITKVLDLCTKLNGR<br>FSNELTDYFDSKDDYAVYVSKFLDFGFKIDEKFPAALLGEF<br>CNKEENGKKIGIYHNGTEPILNSNIIKSKLYGITDVVSRAV<br>KPVSEKLIREYLQQEVKIKPYLENGVCKNKEEQAALRKYQE<br>LKNRIEFRDIVEYSEIINELMGQLINESYLRERDLMYFQLG<br>FHYLCLNNYGAKPEGYYSIVNDKRTIKGAILYQIVAMYTYG<br>LPIYHYVDGTISDRRKNKKTVLDTLNSSETVGAKIKYFIYY<br>SDELFNDSLILYNAGLELFENINEHENIVNLRKYIDHFKYY<br>VSQDRSLLDIYSEVFDRYFTYDRKYKKNVMNLFSNIMLKHF<br>IITDFEFSTGEKTIGEKNTAKKECAKVRIKRGGLSSDKFTY<br>KFKDAKPIELSAKNTEFLDGVARILYYPENVVLTDLVRNSE<br>VEDEKRIEKYDRNHNSSPTRKDKTYKQDVKKNYNKKTSKAF<br>DSSKLDTKSVGNNLSDNPVLKQFLSESKKKR |
| C2-29 | *Blautia* sp.<br>Marseille-<br>P2398<br>(SEQ ID<br>No. 61) | MKISKVDHVKSGIDQKLSSQRGMLYKQPQKKYEGKQLEEHV<br>RNLSRKAKALYQVFPVSGNSKMEKELQIINSFIKNILLRLD<br>SGKTSEEIVGYINTYSVASQISGDHIQELVDQHLKESLRKY<br>TCVGDKRIYVPDIIVALLKSKFNSETLQYDNSELKILIDFI<br>REDYLKEKQIKQIVHSIENNSTPLRIAEINGQKRLIPANVD<br>NPKKSYIFEFLKEYAQSDPKGQESLLQHMRYLILLYLYGPD<br>KITDDYCEEIEAWNFGSIVMDNEQLFSEEASMLIQDRIYVN<br>QQIEEGRQSKDTAKVKKNKSKYRMLGDKIEHSINESVVKHY<br>QEACKAVEEKDIPWIKYISDHVMSVYSSKNRVDLDKLSLPY<br>LAKNTWNTWISFIAMKYVDMGKGVYHFAMSDVDKVGKQDNL<br>IIGQIDPKFSDGISSFDYERIKAEDDLHRSMSGYIAFAVNN<br>FARAICSDEFRKKNRKEDVLTVGLDEIPLYDNVKRKLLQYF<br>GGASNWDDSIIDIIDDKDLVACIKENLYVARNVNFHFAGSE<br>KVQKKQDDILEEIVRKETRDIGKHYRKVFYSNNVAVFYCDE<br>DIIKLMNHLYQREKPYQAQIPSYNKVISKTYLPDLIFMLLK<br>GKNRTKISDPSIMNMFRGTFYFLLKEIYYNDFLQASNLKEM<br>FCEGLKNNVKNKKSEKPYQNFMRRFEELENMGMDFGEICQQ<br>IMTDYEQQNKQKKKTATAVMSEKDKKIRTLDNDTQKYKHFR<br>TLLYIGLREAFIIYLKDEKNKEWYEFLREPVKREQPEEKEF<br>VNKWKLNQYSDCSELILKDSLAAAWYVVAHFINQAQLNHLI<br>GDIKNYIQFISDIDRRAKSTGNPVSESTEIQIERYRKILRV<br>LEFAKFFCGQITNVLTDYYQDENDFSTHVGHYVKFEKKNME<br>PAHALQAFSNSLYACGKEKKKAGFYYDGMNPIVNRNITLAS<br>MYGNKKLLENAMNPVTEQDIRKYYSLMAELDSVLKNGAVCK<br>SEDEQKNLRHFQNLKNRIELVDVLTLSELVNDLVAQLIGWV<br>YIRERDMMYLQLGLHYIKLYFTDSVAEDSYLRTLDLEEGSI<br>ADGAVLYQIASLYSFNLPMYVKPNKSSVYCKKHVNSVATKF<br>DIFEKEYCNGDETVIENGLRLFENINLHKDMVKFRDYLAHF<br>KYFAKLDESILELYSKAYDFFFSYNIKLKKSVSYVLTNVLL<br>SYFINAKLSFSTYKSSGNKTVQHRTTKISVVAQTDYFTYKL<br>RSIVKNKNGVESIENDDRRCEVVNIAARDKEFVDEVCNVIN<br>YNSDK |
| C2-30 | *Leptotrichia*<br>sp.<br>Marseille-<br>P3007<br>(SEQ ID<br>No. 62) | MKITKIDGISHKKYIKEGKLVKSTSEENKTDERLSELLTIR<br>LDTYIKNPDNASEEENRIRRENLKEFFSNKVLYLKDGILYL<br>KDRREKNQLQNKNYSEEDISEYDLKNKNNFLVLKKILLNED<br>INSEELEIFRNDFEKKLDKINSLKYSLEENKANYQKINENN<br>IKKVEGKSKRNIFYNYYKDSAKRNDYINNIQEAFDKLYKKE<br>DIENLFFLIENSKKHEKYKIRECYHKIIGRKNDKENFATII<br>YEEIQNVNNMKELIEKVPNVSELKKSQVFYKYYLNKEKLND<br>ENIKYVFCHFVEIEMSKLLKNYVYKKPSNISNDKVKRIFEY<br>QSLKKLIENKLLNKLDTYVRNCGKYSFYLQDGEIATSDFIV<br>GNRQNEAFLRNIIGVSSTAYFSLRNILETENENDITGRMRG<br>KTVKNNKGEEKYISGEIDKLYDNNKQNEVKKNLKMFYSYDF<br>NMNSKKEIEDFFSNIDEAISSIRHGIVHFNLELEGKDIFTF<br>KNIVPSQISKKMFHDEINEKKLKLKIFKQLNSANVFRYLEK<br>YKILNYLNRTRFEFVNKNIPFVPSFTKLYSRIDDLKNSLGI<br>YWKTPKTNDDNKTKEITDAQIYLLKNIYYGEFLNYFMSNNG<br>NFFEITKEIIELNKNDKRNLKTGFYKLQKFENLQEKTPKEY<br>LANIQSLYMINAGNQDEEEKDTYIDFIQKIFLKGFMTYLAN<br>NGRLSLIYIGSDEETNTSLAEKKQEFDKFLKKYEQNNNIEI<br>PYEINEFVREIKLGKILKYTERLNMFYLILKLLNHKELTNL<br>KGSLEKYQSANKEEAFSDQLELINLLNDNNRVTEDFELEA<br>DEIGKFLDFNGNKVKDNKELKKFDTNKIYFDGENIIKHRAF<br>YNIKKYGMLNLLEKISDEAKYKISIEELKNYSKKKNEIEEN<br>HTTQENLHRKYARPRKDEKFTDEDYKKYEKAIRNIQQYTHL<br>KNKVEFNELNLLQSLLRILHRLVGYTSIWERDLRFRLKGE<br>FPENQYIEEEIFNFDNSKNVKYKNGQIVEKYINFYKELYKDD |

TABLE 2-continued

| | | |
|---|---|---|
| | | TEKISIYSDKKVKELKKEKKDLYIRNYIAHFNYIPNAEISL<br>LEMLENLRKLLSYDRKLKNAIMKSIVDILKEYGFVVTPKIE<br>KDKKIRIESLKSEEVVHLKKLKLKDNDKKKEPIKTYRNSKE<br>LCKLVKVMFEYKMKEKKSEN |
| C2-31 | *Bacteroides ihuae* (SEQ ID No. 63) | MRITKVKVKESSDQKDKMVLIHRKVGEGTLVLDENLADLTA<br>PIIDKYKDKSFELSLLKQTLVSEKEMNIPKCDKCTAKERCL<br>SCKQREKRLKEVRGAIEKTIGAVIAGRDIIPRLNIFNEDEI<br>CWLIKPKLRNEFTFKDVNKQVVKLNLPKVLVEYSKKNDPTL<br>FLAYQQWIAAYLKNKKGHIKKSILNNRVVIDYSDESKLSKR<br>KQALELWGEEYETNQRIALESYHTSYNIGELVTLLPNPEEY<br>VSDKGEIRPAFHYKLKNVLQMHQSTVFGTNEILCINPIFNE<br>NRANIQLSAYNLEVVKYFEHYFPIKKKKKNLSLNQAIYYLK<br>VETLKERLSLQLENALRMNLLQKGKIKKHEFDKNTCSNTLS<br>QIKRDEFFVLNLVEMCAFAANNIRNIVDKEQVNEILSKKDL<br>CNSLSKNTIDKELCTKFYGADFSQIPVAIWAMRGSVQQIRN<br>EIVHYKAEAIDKIFALKTFEYDDMEKDYSDTPFKQYLELSI<br>EKIDSFFIEQLSSNDVLNYYCTEDVNKLLNKCKLSLRRTSI<br>PFAPGFKTIYELGCHLQDSSNTYRIGHYLMLIGGRVANSTV<br>TKASKAYPAYRFMLKLIYNHLFLNKFLDNHNKRFFMKAVAF<br>VLKDNRENARNKFQYAFKEIRMMNNDESIASYMSYIHSLSV<br>QEQEKKGDKNDKVRYNTEKFIEKVFVKGFDDFLSWLGVEFI<br>LSPNQEERDKTVTREEYENLMIKDRVEHSINSNQESHIAFF<br>TFCKLLDANHLSDLRNEWIKFRSSGDKEGFSYNFAIDIIEL<br>CLLTVDRVEQRRDGYKEQTELKEYLSFFIKGNESENTVWKG<br>FYFQQDNYTPVLYSPIELIRKYGTLELLKLIIVDEDKITQG<br>EFEEWQTLKKVVEDKVTRRNELHQEWEDMKNKSSFSQEKCS<br>IYQKLCRDIDRYNWLDNKLHLVHLRKLHNLVIQILSRMARF<br>IALWDRDFVLLDASRANDDYKLLSFFNFRDFINAKKTKTDD<br>ELLAEFGSKIEKKNAPFIKAEDVPLMVECIEAKRSFYQKVF<br>FRNNLQVLADRNFIAHYNYISKTAKCSLFEMIIKLRTLMYY<br>DRKLRNAVVKSIANVFDQNGMVLQLSLDDSHELKVDKVISK<br>RIVHLKNNNIMTDQVPEEYYKICRRLLEMKK |
| C2-32 | SAMN052 16357_1045 [*Porphyromonadaceae bacterium* KH3CP3RA] (SEQ ID No. 64) | MEFRDSIFKSLLQKEIEKAPLCFAEKLISGGVFSYYPSERL<br>KEFVGNHPFSLFRKTMPFSPGFKRVMKSGGNYQNANRDGRF<br>YDLDIGVYLPKDGFGDEEWNARYFLMKLIYNQLFLPYFADA<br>ENHLFRECVDFKVRVNRDYNCKNNNSEEQAFIDIRSMREDE<br>SIADYLAFIQSNIIIEENKKKETNKEGQINFNKFLLQVFVK<br>GFDSFLKDRTELNFLQLPELQGDGTRGDDLESLDKLGAVVA<br>VDLKLDATGIDADLNENISFYTFCKLLDSNHLSRLRNEIIK<br>YQSANSDFSHNEDFDYDRIISIIELCMLSADHVSTNDNESI<br>FPNNDKDFSGIRPYLSTDAKVETFEDLYVHSDAKTPITNAT<br>MVLNWKYGTDKLFERLMISDQDFLVTEKDYFVWKELKKDIE<br>EKIKLREELHSLWVNTPKGKKGAKKKNGRETTGEFSEENKK<br>EYLEVCREIDRYVNLDNKLHFVHLKRMHSLLIELLGRFVGF<br>TYLFERDYQYYHLEIRSRRNKDAGVVDKLEYNKIKDQNKYD<br>KDDFFACTFLYEKANKVRNFIAHFNYLTMWNSPQEEEHNSN<br>LSGAKNSSGRQNLKCSLTELINELREVMSYDRKLKNAVTKA<br>VIDLFDKHGMVIKFRIVNNNNNDNKNKHHLELDDIVPKKIM<br>HLRGIKLKRQDGKPIPIQTDSVDPLYCRMWKKLLDLKPTPF |
| C2-33 | *Listeria riparia* (SEQ ID No. 65) | MHDAWAENPKKPQSDAFLKEYKACCEAIDTYNWHKNKATLV<br>YVNELHHLLIDILGRLVGYVAIADRDFQCMANQYLKSSGHT<br>ERVDSWINTIRKNRPDYIEKLDIFMNKAGLFVSEKNGRNYI<br>AHLNYLSPKHKYSLLYLFEKLREMLKYDRKLKNAVTKSLID<br>LLDKHGMCVVFANLKNNKHRLVIASLKPKKIETFKWKKIK |
| C2-34 | *Insolitispirillum peregrinum* (SEQ ID No. 66) | MRIIRPYGSSTVASPSPQDAQPLRSLQRQNGTFDVAEFSRR<br>HPELVLAQWVAMLDKIIRKPAPGKNSTALPRPTAEQRRLRQ<br>QVGAALWAEMQRHTPVPPELKAVWDSKVHPYSKDNAPATAK<br>TPSHRGRWYDRFGDPETSAATVAEGVRRHLLDSAQPFRANG<br>GQPKGKGVIEHRALTIQNGTLLHHHQSEKAGPLPEDWSTYR<br>ADELVSTIGKDARWIKVAASLYQHYGRIFGPTTPISEAQTR<br>PEFVLHTAVKAYYRRLFKERKLPAERLERLLPRTGEALRHA<br>VTVQHGNRSLADAVRIGKILHYGWLQNGEPDPWPDDAALYS<br>SRYWGSDGQTDIKHSEAVSRVWRRALTAAQRTLTSWLYPAG<br>TDAGDILLIGQKPDSIDRNRLPLLYGDSTRHWTRSPGDVWL<br>FLKQTLENLRNSSFHFKTLSAFTSHLDGTCESEPAEQQAAQ<br>ALWQDDRQQDHQQVFLSLRALDATTYLPTGPLHRIVNAVQS<br>TDATLPLPRFRRVVTRAANTRLKGFPVEPVNRRTMEDDPLL<br>RCRYGVLKLLYERGFRAWLETRPSIASCLDQSLKRSTKAAQ<br>TINGKNSPQGVEILSRATKLLQAEGGGGHGIHDLFDRLYAA<br>TAREMRVQVGYHHDAEAARQQAEFIEDLKCEVVARAFCAYL<br>KTLGIQGDTFRRQPEPLPTWPDLPDLPSSTIGTAQAALYSV<br>LHLMPVEDVGSLLHQLRRWLVALQARGGEDGTAITATIPLL<br>ELYLNRHDAKFSGGGAGTGLRWDDWQVFFDCQATFDRVFPP<br>GPALDSHRLPLRGLREVLRFGRVNDLAALIGQDKITAAEVD<br>RWHTAEQTIAAQQQRREALHEQLSRKKGTDAEVDEYRALVT<br>AIADHRHLTAHVTLSNVVRLHRLMTTVLGRLVDYGGLWERD |

TABLE 2-continued

```
LTFVTLYEAHRLGGLRNLLSESRVNKFLDGQTPAALSKKNN
AEENGMISKVLGDKARRQIRNDFAHFNMLQQGKKTINLTDE
INNARKLMAHDRKLKNAITRSVTTLLQQDGLDIVWTMDASH
RLTDAKIDSRNAIHLHKTHNRANIREPLHGKSYCRWVAALF
GATSTPSATKKSDKIR
```

In certain example embodiments, the CRISPR effector protein is a Cas13b protein selected from Table 3.

TABLE 3

| Organism | No. | Sequence |
|---|---|---|
| *Bergeyella zoohelcum* (SEQ ID No. 67) | 1 | MENKTSLGNNIYYNPFKPQDKSYFAGYFNAAMENTDSVFRELG KRLKGKEYTSENFFDAIFKENISLVEYERYVKLLSDYFPMARL LDKKEVPIKERKENFKKNFKGIIKAVRDLRNFYTHKEHGEVEI TDEIFGVLDEMLKSTVLTVKKKKVKTDKTKEILKKSIEKQLDI LCQKKLEYLRDTARKIEEKRRNQRERGEKELVAPFKYSDKRDD LIAAIYNDAFDVYIDKKKDSLKESSKAKYNTKSDPQQEEGDLK IPISKNGVVFLLSLFLTKQEIHAFKSKIAGFKATVIDEATVSE ATVSHGKNSICFMATHEIFSHLAYKKLRKVRTAEINYGEAEN AEQLSVYAKETLMMQMLDELSKVPDVVYQNLSEDVQKTFIEDW NEYLKENNGDVGTMEEEQVIHPVIRKRYEDKFNYFAIRFLDEF AQFPTLRFQVHLGNYLHDSRPKENLISDRRIKEKITVFGRLSE LEHKKALFIKNTETNEDREHYWEIFPNPNYDFPKENISVNDKD FPIAGSILDREKQPVAGKIGIKVKLLNQQYVSEVDKAVKAHQL KQRKASKPSIQNIIEEIVPINESNPKEAIVFGGQPTAYLSMND IHSILYEFFDKWEKKKEKLEKKGEKELRKEIGKELEKKIVGKI QAQIQQIIDKDTNAKILKPYQDGNSTAIDKEKLIKDLKQEQNI LQKLKDEQTVREKEYNDFIAYQDKNREINKVRDRNHKQYLKDN LKRKYPEAPARKEVLYYREKGKVAVWLANDIKRFMPTDFKNEW KGEQHSLLQKSLAYYEQCKEELKNLLPEKVFQHLPFKLGGYFQ QKYLYQFYTCYLDKRLEYISGLVQQAENFKSENKVFKKVENEC FKFLKKQNYTHKELDARVQSILGYPIFLERGFMDEKPTIIKGK TFKGNEALFADWFRYYKEYQNFQTFYDTENYPLVELEKKQADR KRKTKIYQQKKNDVFTLLMAKHIFKSVFKQDSIDQFSLEDLYQ SREERLGNQERARQTGERNTNYIWNKTVDLKLCDGKITVENVK LKNVGDFIKYEYDQRVQAFLKYEENIEWQAFLIKESKEEENYP YVVEREIEQYEKVRREELLKEVHLIEEYILEKVKDKEILKKGD NQNFKYYILNGLLKQLKNEDVESYKVFNLNTEPEDVNINQLKQ EATDLEQKAFVLTYIRNKFAHNQLPKKEFWDYCQEKYGKIEKE KTYAEYFAEVFKKEKEALIK |
| *Prevotella intermedia* (SEQ ID No. 68) | 2 | MEDDKKTTDSIRYELKDKHFWAAFLNLARHNVYITVNHINKIL EEGEINRDGYETTLKNTWNEIKDINKKDRLSKLIIKHPPFLEA ATYRLNPTDTTKQKEEKQAEAQSLESLRKSEEVFIYKLRDLRN HYSHYKHSKSLERPKEEEGLLEKMYNIENASIRLVKEDYQYNK DINPDEDEKHLDRTEEEENYYFTKDNEGNITESGLLEFVSLFL EKKDAIWMQQKLRGFKDNRENKKKMTNEVFCRSRMLLPKLRLQ STQTQDWILLDMLNELIRCPKSLYERLREEDREKFRVPIEIAD EDYDAEQEPEKNTLVRHQDREPYFALRYEDYNEIFTNLRFQID LGTYHFSTYKKQIGDYKESHHLTHKLYGFERIQEFTKQNRPDE WRKFVKTFNSFETSKEPYIPETTPHYHLENQKIGIRERNDNDK IWPSLKTNSEKNEKSKYKLDKSFQAEAFLSVHELLPMMFYYLL LKTENTDNDNEIETKKKENKNDKQEKHKIEEIIENKITEIYAL YDTFANGEIKSIDELEEYCKGKDIEIGHLPKQMIAILKDEHKV MATEAERKQEEMLVDVQKSLESLDNQINEEIENVERKNSSLKS GKIASWLVNDMMRFQPVQKDNEGKPLNNSKANSTEYQLLQRTL AFFGSEHERLAPYFKQTKLIESSNPHPFLKDTEWEKCNNILSF YRSYLEAKKNFLESLKPEDWEKNQYFLKLKEPKTKPKTLVQGW KNGENLPRGIFTEPIRKWFMKHRENITVAELKRVGLVAKVIPL EFSEEYKDSVQPFYNYHENVGNINKPDEKNELNCEERRELLRK KKDEEKKMTDKEKEENPSYLEEKSWNKFERELRLVRNQDIVTW LLCMELENKKKIKELNVEKIYLKNINTNTTKKEKNTEEKNGEE KNIKEKNNILNRIMPMRLPIKVYGRENFSKNKKKIRRNTEET VYIEEKGTKLLKQGNEKALERDRRLGGLFSFVKTPSKAESKSN TISKLRVEYELGEYQKARIEIIKDMLALEKTLIDKYNSLDTDN FNKMLTDWLELKGEPDKASFQNDVDLLIAVRNAFSHNQYPMRN RIAFANINPFSLSSANTSEEKGLGIANQLKDKTHKTIEKIIEI EKPIETKE |
| *Prevotella buccae* (SEQ ID No. 69) | 3 | MQKQDKLEVDRKKNAIFAFPKYITIMENKEKPEPIYYELTDKH FWAAFLNLARHNVYTTINHINRRLEIAELKDDGYMMGIKGSWN EQAKKLDKKVRLRDLIMKHFPFLEAAAYEMTNSKSPNNKEQRE KEQSEALSLNNLKNVLFIFLEKLQVLRNYYSHYKYSEESPKPI FETSLLKNMYKVEDANVRLVKRDYMHHENIDMQRDETHLNRKK QVGRTKNIIDSPNEHYHFADKEGNMTIAGLLEFVSLELDKKDA IWMQKKLKGFKDGRNLREQMTNEVFCRSRISLPKLKLENVQTK DWMQLDMLNELVRCPKSLYERLREKDRESEKVPFDIFSDDYNA |

TABLE 3-continued

| | | |
|---|---|---|
| | | EEEPFKNTLVRHQDRFPYFVLRYFDLNEIFEQLRFQIDLGTYH<br>FSIYNKRIGDEDEVRHLTHHLYGPARIQDFAPQNQPEEWRKLV<br>KDLDHFETSQEPYISKTAPHYHLENEKIGIKFCSAHNNLFPSL<br>QTDKTCNGRSKFNLGTQFTAEAFLSVHELLPMMFYYLLLTKDY<br>SRKESADKVEGIIRKEISNIYAIYDAFANNEINSIADLTRRLQ<br>NTNILQGHLPKQMISILKGRQKDMGKEAERKIGEMIDDTQRRL<br>DLLCKQTNQKIRIGKRNAGLLKSGKIADWLVNDMMRFQPVQKD<br>QNNIPINNSKANSTEYRMLQRALALFGSENFRLKAYFNQMNLV<br>GNDNPHPFLAETQWEHQTNILSFYRNYLEARKKYLKGLKPQNW<br>KQYQHFLILKVQKTNRNTLVTGWKNSFNLPRGIFTQPIREWFE<br>KHNNSKRIYDQILSFDRVGFVAKAIPLYFAEEYKDNVQPFYDY<br>PFNIGNRLKPKKRQFLDKKERVELWQKNKELFKNYPSEKKKTD<br>LAYLDFLSWKKFERELRLIKNQDIVTWLMFKELFNMATVEGLK<br>IGEIHLRDIDTNTANEESNNILNRIMPMKLPVKTYETDNKGNI<br>LKERPLATFYIEETETKVLKQGNFKALVKDRRLNGLFSFAETT<br>DLNLEEHPISKLSVDLELIKYQTTRISIFEMTLGLEKKLIDKY<br>STLPTDSFRNMLERWLQCKANRPELKNYVNSLIAVRNAFSHNQ<br>YPMYDATLFAEVKKFTLFPSVDTKKIELNIAPQLLEIVGKAIK<br>EIEKSENKN |
| Porphyromonas<br>gingivalis<br>(SEQ ID<br>No. 70) | 4 | MNTVPASENKGQSRTVEDDPQYFGLYLNLARENLIEVESHVRI<br>KFGKKKLNEESLKQSLLCDHLLSVDRWTKVYGHSRRYLPFLHY<br>FDPDSQIEKDHDSKTGVDPDSAQRLIRELYSLLDFLRNDFSHN<br>RLDGTTFEHLEVSPDISSFITGTYSLACGRAQSRFAVFFKPDD<br>FVLAKNRKEQLISVADGKECLTVSGFAFFICLFLDREQASGML<br>SRIRGFKRTDENWARAVHETFCDLCIRHPHDRLESSNTKEALL<br>LDMLNELNRCPRILYDMLPEEERAQFLPALDENSMNNLSENSL<br>DEESRLLWDGSSDWAEALTKRIRHQDRFPYLMLRFIEEMDLLK<br>GIRFRVDLGEIELDSYSKKVGRNGEYDRTITDHALAFGKLSDF<br>QNEEEVSRMISGEASYPVRFSLFAPRYAIYDNKIGYCHTSDPV<br>YPKSKTGEKRALSNPQSMGFISVHDLRKLLLMELLCEGSFSRM<br>QSDFLRKANRILDETAEGKLQFSALFPEMRHRFIPPQNPKSKD<br>RREKAETTLEKYKQEIKGRKDKLNSQLLSAFDMDQRQLPSRLL<br>DEWMNIRPASHSVKLRTYVKQLNEDCRLRLRKFRKDGDGKARA<br>IPLVGEMATFLSQDIVRMIISEETKKLITSAYYNEMQRSLAQY<br>AGEENRRQFRAIVAELRLLDPSSGHPFLSATMETAHRYTEGFY<br>KCYLEKKREWLAKIFYRPEQDENTKRRISVFFVPDGEARKLLP<br>LLIRRRMKEQNDLQDWIRNKQAHPIDLPSHLFDSKVMELLKVK<br>DGKKKWNEAFKDWWSTKYPDGMQPFYGLRRELNIHGKSVSYIP<br>SDGKKFADCYTHLMEKTVRDKKRELRTAGKPVPPDLAADIKRS<br>FHRAVNEREFMLRLVQEDDRLMLMAINKMMTDREEDILPGLKN<br>IDSILDEENQFSLAVHAKVLEKEGEGGDNSLSLVPATIEIKSK<br>RKDWSKYIRYRYDRRVPGLMSHFPEHKATLDEVKTLLGEYDRC<br>RIKIFDWAFALEGAIMSDRDLKPYLHESSSREGKSGEHSTLVK<br>MLVEKKGCLTPDESQYLILIRNKAAHNQFPCAAEMPLIYRDVS<br>AKVGSIEGSSAKDLPEGSSLVDSLWKKYEMIIRKILPILDPEN<br>RFFGKLLNNMSQPINDL |
| Bacteroides<br>pyogenes<br>(SEQ ID<br>No. 71) | 5 | MESIKNSQKSTGKTLQKDPPYFGLYLNMALLNVRKVENHIRKW<br>LGDVALLPEKSGFHSLLTTDNLSSAKWTRFYYKSRKFLPFLEM<br>FDSDKKSYENRRETAECLDTIDRQKISSLLKEVYGKLQDIRNA<br>FSHYHIDDQSVKHTALITSSEMHRFIENAYSFALQKTRARFTG<br>VFVETDFLQAEEKGDNKKFFAIGGNEGIKLKDNALIFLICLFL<br>DREEAFKFLSRATGFKSTKEKGFLAVRETFCALCCRQPHERLL<br>SVNPREALLMDMLNELNRCPDILFEMLDEKDQKSFLPLLGEEE<br>QAHILENSLNDELCEAIDDPFEMIASLSKRVRYKNRFPYLMLR<br>YIEEKNLLPFIRFRIDLGCLELASYPKKMGEENNYERSVTDHA<br>MAFGRLTDFHNEDAVLQQITKGITDEVRFSLYAPRYAIYNNKI<br>GFVRTSGSDKISFPTLKKKGGEGHCVAYTLQNTKSFGFISIYD<br>LRKILLLSFLDKDKAKNIVSGLLEQCEKHWKDLSENLFDAIRT<br>ELQKEFPVPLIRYTLPRSKGGKLVSSKLADKQEKYESEFERRK<br>EKLTEILSEKDFDLSQIPRRMIDEWLNVLPTSREKKLKGYVET<br>LKLDCRERLRVFEKREKGEHPLPPRIGEMATDLAKDIIRMVID<br>QGVKQRITSAYYSEIQRCLAQYAGDDNRRHLDSIIRELRLKDT<br>KNGHPFLGKVLRPGLGHTEKLYQRYFEEKKEWLEATFYPAASP<br>KRVPRFVNPPTGKQKELPLIIRNLMKERPEWRDWKQRKNSHPI<br>DLPSQLFENEICRLLKDKIGKEPSGKLKWNEMPFKLYWDKEFPN<br>GMQRFYRCKRRVEVFDKVVEYEYSEEGGNYKKYYEALIDEVVR<br>QKISSSKEKSKLQVEDLTLSVRRVFKRAINEKEYQLRLLCEDD<br>RLLFMAVRDLYDWKEAQLDLDKIDNMLGEPVSVSQVIQLEGGQ<br>PDAVIKAECKLKDVSKLMRYCYDGRVKGLMPYFANHEATQEQV<br>EMELRHYEDHRRRVFNWVFALEKSVLKNEKLRRFYEESQGGCE<br>HRRCIDALRKASLVSEEEYEFLVHIRNKSAHNQFPDLEIGKLP<br>PNVTSGFCECIWSKYKAIICRIIPFIDPERRFFGKLLEQK |
| Alistipes<br>sp.<br>ZOR0009<br>(SEQ ID<br>No. 72) | 6 | MSNEIGAFREHQFAYAPGNEKQEEATFATYFNLALSNVEGMMF<br>GEVESNPDKIEKSLDTLPPAILRQIASFIWLSKEDHPDKAYST<br>EEVKVIVTDLVRRLCFYRNYFSHCFYLDTQYFYSDELVDTTAI<br>GEKLPYNFHHFITNRLFRYSLPEITLFRWNEGERKYEILRDGL<br>IFFCCLFLKRGQAERFLNELRFFKRTDEEGRIKRTIFTKYCTR |

TABLE 3-continued

| | | |
|---|---|---|
| | | ESHKHIGIEEQDFLIFQDIIGDLNRVPKVCDGVVDLSKENERY<br>IKNRETSNESDENKARYRLLIREKDKFPYYLMRYIVDFGVLPC<br>ITFKQNDYSTKEGRGQFHYQDAAVAQEERCYNFVVRNGNVYYS<br>YMPQAQNVVRISELQGTISVEELRNMVYASINGKDVNKSVEQY<br>LYHLHLLYEKILTISGQTIKEGRVDVEDYRPLLDKLLLRPASN<br>GEELRRELRKLLPKRVCDLLSNRFDCSEGVSAVEKRLKAILLR<br>HEQLLLSQNPALHIDKIKSVIDYLYLFFSDDEKFRQQPTEKAH<br>RGLKDEEFQMYHYLVGDYDSHPLALWKELEASGRLKPEMRKLT<br>SATSLHGLYMLCLKGTVEWCRKQLMSIGKGTAKVEAIADRVGL<br>KLYDKLKEYTPEQLEREVKLVVMHGYAAAATPKPKAQAAIPSK<br>LTELRFYSFLGKREMSFAAFIRQDKKAQKLWLRNFYTVENIKT<br>LQKRQAAADAACKKLYNLVGEVERVHTNDKVLVLVAQRYRERL<br>LNVGSKCAVTLDNPERQQKLADVYEVQNAWLSIRFDDLDFTLT<br>HVNLSNLRKAYNLIPRKHILAFKEYLDNRVKQLCEECRNVRR<br>KEDLCTCCSPRYSNLTSWLKENHSESSIEREAATMMLLDVERK<br>LLSFLLDERRKAIIEYGKFIPFSALVKECRLADAGLCGIRNDV<br>LHDNVISYADAIGKLSAYFPKEASEAVEYIRRTKEVREQRREE<br>LMANSSQ |
| Prevotella<br>sp.<br>MA2016<br>(SEQ ID<br>No. 73) | 7a | MSKECKKQRQEKKRRLQKANFSISLTGKHVFGAYFNMARTNFV<br>KTINYILPIAGVRGNYSENQINKMLHALFLIQAGRNEELTTEQ<br>KQWEKKLRLNPEQQTKFQKLLFKHFPVLGPMMADVADHKAYLN<br>KKKSTVQTEDETFAMLKGVSLADCLDIICLMADTLTECRNFYT<br>HKDPYNKPSQLADQYLHQEMIAKKLDKVVVASRRILKDREGLS<br>VNEVEFLTGIDHLHQEVLKDEFGNAKVKDGKVMKTFVEYDDFY<br>FKISGKRLVNGYTVTTKDDKPVNVNTMLPALSDFGLLYFCVLE<br>LSKPYAKLFIDEVRLFEYSPFDDKENMIMSEMLSIYRIRTPRL<br>HKIDSHDSKATLAMDIFGELRRCPMELYNLLDKNAGQPFFHDE<br>VKHPNSHTPDVSKRLRYDDRFPTLALRYIDETELFKRIRFQLQ<br>LGSFRYKFYDKENCIDGRVRVRRIQKEINGYGRMQEVADKRMD<br>KWGDLIQKREERSVKLEHEELYINLDQFLEDTADSTPYVTDRR<br>PAYNIHANRIGLYWEDSQNPKQYKVFDENGMYIPELVVTEDKK<br>APIKMPAPRCALSVYDLPAMLFYEYLREQQDNEFPSAEQVIIE<br>YEDDYRKFFKAVAEGKLKPFKRPKEFRDFLKKEYPKLRMADIP<br>KKLQLFLCSHGLCYNNKPETVYERLDRLTLQHLEERELHIQNR<br>LEHYQKDRDMIGNKDNQYGKKSFSDVRHGALARYLAQSMMEWQ<br>PTKLKDKEKGHDKLTGLNYNVLTAYLATYGHPQVPEEGFTPRT<br>LEQVLINAHLIGGSNPHPFINKVLALGNRNIEELYLHYLEEEL<br>KHIRSRIQSLSSNPSDKALSALPFIHHDRMRYHERTSEEMMAL<br>AARYTTIQLPDGLFTPYILEILQKHYTENSDLQNALSQDVPVK<br>LNPTCNAAYLITLFYQTVLKDNAQPFYLSDKTYTRNKDGEKAE<br>SFSFKRAYELFSVLNNNKKDTFPPFEMIPLFLTSDEIQERLSAK<br>LLDGDGNPVPEVGEKGKPATDSQGNTIWKRRIYSEVDDYAEKL<br>TDRDMKISFKGEWEKLPRWKQDKIIKRRDETRRQMRDELLQRM<br>PRYIRDIKDNERTLRRYKTQDMVLELLAEKMFTNIISEQSSEF<br>NWKQMRLSKVCNEAFLRQTLTERVPVTVGETTIYVEQENMSLK<br>NYGEFYRFLTDDRLMSLLNNIVETLKPNENGDLVIRHTDLMSE<br>LAAYDQYRSTIFMLIQSIENLIITNNAVLDDPDADGFWVREDL<br>PKRNNFASLLELINQLNNVELTDDERKLLVAIRNAFSHNSYNI<br>DFSLIKDVKHLPEVAKGILQHLQSMLGVEITK |
| Prevotella<br>sp.<br>MA2016<br>(SEQ ID<br>No. 74) | 7b | MSKECKKQRQEKKRRLQKANFSISLTGKHVFGAYFNMARTNFV<br>KTINYILPIAGVRGNYSENQINKMLHALFLIQAGRNEELTTEQ<br>KQWEKKLRLNPEQQTKFQKLLFKHFPVLGPMMADVADHKAYLN<br>KKKSTVQTEDETFAMLKGVSLADCLDIICLMADTLTECRNFYT<br>HKDPYNKPSQLADQYLHQEMIAKKLDKVVVASRRILKDREGLS<br>VNEVEFLTGIDHLHQEVLKDEFGNAKVKDGKVMKTFVEYDDFY<br>FKISGKRLVNGYTVTTKDDKPVNVNTMLPALSDFGLLYFCVLE<br>LSKPYAKLFIDEVRLFEYSPFDDKENMIMSEMLSIYRIRTPRL<br>HKIDSHDSKATLAMDIFGELRRCPMELYNLLDKNAGQPFFHDE<br>VKHPNSHTPDVSKRLRYDDRFPTLALRYIDETELFKRIRFQLQ<br>LGSFRYKFYDKENCIDGRVRVRRIQKEINGYGRMQEVADKRMD<br>KWGDLIQKREERSVKLEHEELYINLDQFLEDTADSTPYVTDRR<br>PAYNIHANRIGLYWEDSQNPKQYKVFDENGMYIPELVVTEDKK<br>APIKMPAPRCALSVYDLPAMLFYEYLREQQDNEFPSAEQVIIE<br>YEDDYRKFFKAVAEGKLKPFKRPKEFRDFLKKEYPKLRMADIP<br>KKLQLFLCSHGLCYNNKPETVYERLDRLTLQHLEERELHIQNR<br>LEHYQKDRDMIGNKDNQYGKKSFSDVRHGALARYLAQSMMEWQ<br>PTKLKDKEKGHDKLTGLNYNVLTAYLATYGHPQVPEEGFTPRT<br>LEQVLINAHLIGGSNPHPFINKVLALGNRNIEELYLHYLEEEL<br>KHIRSRIQSLSSNPSDKALSALPFIHHDRMRYHERTSEEMMAL<br>AARYTTIQLPDGLFTPYILEILQKHYTENSDLQNALSQDVPVK<br>LNPTCNAAYLITLFYQTVLKDNAQPFYLSDKTYTRNKDGEKAE<br>SFSFKRAYELFSVLNNNKKDTFPPFEMIPLFLTSDEIQERLSAK<br>LLDGDGNPVPEVGEKGKPATDSQGNTIWKRRIYSEVDDYAEKL<br>TDRDMKISFKGEWEKLPRWKQDKIIKRRDETRRQMRDELLQRM<br>PRYIRDIKDNERTLRRYKTQDMVLFLLAEKMFTNIISEQSSEF<br>NWKQMRLSKVCNEAFLRQTLTFRVPVTVGETTIYVEQENMSLK<br>NYGEFYRFLTDDRLMSLLNNIVETLKPNENGDLVIRHTDLMSE<br>LAAYDQYRSTIFMLIQSIENLIITNNAVLDDPDADGFWVREDL |

TABLE 3-continued

| | | |
|---|---|---|
| | | PKRNNFASLLELINQLNNVELTDDERKLLVAIRNAFSHNSYNI<br>DFSLIKDVKHLPEVAKGILQHLQSMLGVEITK |
| *Riemerella*<br>*anatipestifer*<br>(SEQ ID<br>No. 75) | 8 | MEKPLLPNVYTLKHKFFWGAFLNIARHNAFITICHINEQLGLK<br>TPSNDDKIVDVVCETWNNILNNDHDLLKKSQLTELILKHFPFL<br>TAMCYHPPKKEGKKKGHQKEQQKEKESEAQSQAEALNPSKLIE<br>ALEILVNQLHSLRNYYSHYKHKKPDAEKDIFKHLYKAFDASLR<br>MVKEDYKAHFTVNLTRDFAHLNRKGKNKQDNPDFNRYRFEKDG<br>FFTESGLLFFTNLFLDKRDAYWMLKKVSGFKASHKQREKMTTE<br>VFCRSRILLPKLRLESRYDHNQMLLDMLSELSRCPKLLYEKLS<br>EENKKHFQVEADGFLDEIEEEQNPFKDTLIRHQDRFPYFALRY<br>LDLNESFKSIRFQVDLGTYHYCIYDKKIGDEQEKRHLTRTLLS<br>FGRLQDFTEINRPQEWKALTKDLDYKETSNQPFISKTTPHYHI<br>TDNKIGFRLGTSKELYPSLEIKDGANRIAKYPYNSGFVAHAFI<br>SVHELLPLMFYQHLTGKSEDLLKETVRHIQRIYKDFEEERINT<br>IEDLEKANQGRLPLGAFPKQMLGLLQNKQPDLSEKAKIKIEKL<br>IAETKLLSHRLNTKLKSSPKLGKRREKLIKTGVLADWLVKDFM<br>RFQPVAYDAQNQPIKSSKANSTEFWFIRRALALYGGEKNRLEG<br>YFKQTNLIGNTNPHPFLNKFNWKACRNLVDFYQQYLEQREKFL<br>EAIKNQPWEPYQYCLLLKIPKENRKNLVKGWEQGGISLPRGLF<br>TEAIRETLSEDLMLSKPIRKEIKKHGRVGFISRAITLYFKEKY<br>QDKHQSFYNLSYKLEAKAPLLKREEHYEYWQQNKPQSPTESQR<br>LELHTSDRWKDYLLYKRWQHLEKKLRLYRNQDVMLWLMTLELT<br>KNHFKELNLNYHQLKLENLAVNVQEADAKLNPLNQTLPMVLPV<br>KVYPATAFGEVQYHKTPIRTVYIREEHTKALKMGNFKALVKDR<br>RLNGLFSFIKEENDTQKHPISQLRLRRELEIYQSLRVDAFKET<br>LSLEEKLLNKHTSLSSLENEFRALLEEWKKEYAASSMVTDEHI<br>AFIASVRNAFCHNQYPFYKEALHAPIPLFTVAQPTTEEKDGLG<br>IAEALLKVLREYCEIVKSQI |
| *Prevotella*<br>*aurantiaca*<br>(SEQ ID<br>No. 76) | 9 | MEDDKKTTGSISYELKDKHFWAAFLNLARHNVYITINHINKLL<br>EIREIDNDEKVLDIKTLWQKGNKDLNQKARLRELMTKHFPFLE<br>TAIYTKNKEDKKEVKQEKQAEAQSLESLKDCLFLFLDKLQEAR<br>NYYSHYKYSEFSKEPEFEEGLLLEKMYNIFGNNIQLVINDYQHN<br>KDINPDEDFKHLDRKGQFKYSFADNEGNITESGLLFFVSLFLE<br>KKDAIWMQQKLNGEKDNLENKKKMTHEVFCRSRILMPKLRLES<br>TQTQDWILLDMLNELIRCPKSLYERLQGDDREKFKVPFDPADE<br>DYNAEQEPPFKNTLIRHQDREPYFVLRYFDYNEIFKNLRFQIDL<br>GTYHFSIYKKLIGGQKEDRHLTHKLYGFERIQEFAKQNRPDEW<br>KAIVKDLDTYETSNKRYISETTPHYHLENQKIGIRFRNGNKEI<br>WPSLKTNDENNEKSKYKLDKQYQAEAFLSVHELLPMMFYYLLL<br>KKEKPNNDEINASIVEGFIKREIRNIFKLYDAFANGEINNIDD<br>LEKYCADKGIPKRHLPKQMVAILYDEHKDMVKEAKRKQKEMVK<br>DTKKLLATLEKQTQKEKEDDGRNVKLLKSGEIARWLVNDMMRF<br>QPVQKDNEGKPLNNSKANSTEYQMLQRSLALYNNEEKPTRYFR<br>QVNLIESNNPHPFLKWTKWEECNNILTFYYSYLTKKIEFLNKL<br>KPEDWKKNQYFLKLKEPKTNRETLVQGWKNGFNLPRGIFTEPI<br>REWFKRHQNNSKEYEKVEALDRVGLVTKVIPLEFKEEYEKDKE<br>ENEKEDTQKEINDCVQPFYNFPYNVGNIHKPKEKDFLHREERI<br>ELWDKKKDKFKGYKEKIKSKKLTEKDKEEFRSYLEFQSWNKFE<br>RELRLVRNQDIVTWLLCKELIDKLKIDELNIEELKKLRLNNID<br>TDTAKKEKNNILNRVMPMELPVTVYEIDDSHKIVDKPLHTIY<br>IKEAETKLLKQGNFKALVKDRRLNGLFSFVKTNSEAESKRNPI<br>SKLRVEYELGEYQEARIEIIQDMLALEEKLINKYKDLPTNKFS<br>EMLNSWLEGKDEADKARFQNDVDFLIAVRNAFSHNQYPMHNKI<br>EFANIKPFSLYTANNSEEKGLGIANQLKDKTKETTDKIKKIEK<br>PIETKE |
| *Prevotella*<br>*saccharolytica*<br>(SEQ ID<br>No. 77) | 10 | MEDKPFWAAFFNLARHNVYLTVNHINKLLDLEKLYDEGKHKEI<br>FEREDIFNISDDVMNDANSNGKKRKLDIKKIWDDLDTDLTRKY<br>QLRELILKHFPFIQPAIIGAQTKERTTIDKDKRSTSTSNDSLK<br>QTGEGDINDLLSLSNVKSMFFRLLQILEQLRNYYSHVKHSKSA<br>TMPNFDEDLLNWMRYIFIDSVNKVKEDYSSNSVIDPNTSFSHL<br>IYKDEQGKIKPCRYPFTSKDGSINAFGLLFFVSLFLEKQDSIW<br>MQKKIPGFKKASENYMKKMTNEVFCRNHILLPKIRLETVYDKDW<br>MLLDMLNEVVRCPLSLYKRLTPAAQNKFKVPEKSSDNANRQED<br>DNPFSRILVRHQNRFPYFVLRFFDLNEVFTTLRFQINLGCYHF<br>AICKKQIGDKKEVHHLIRTLYGFSRLQNFTQNTRPEEWNTLVK<br>TTEPSSGNDGKTVQGVPLPYISYTIPHYQIENEKIGIKIFDGD<br>TAVDTDIWPSVSTEKQLNKPDKYTLTPGFKADVFLSVHELLPM<br>MFYYQLLLCEGMLKTDAGNAVEKVLIDTRNAIFNLYDAFVQEK<br>INTITDLENYLQDKPILIGHLPKQMIDLLKGHQRDMLKAVEQK<br>KAMLIKDTERRLKLLDKQLKQETDVAAKNTGTLLKNGQIADWL<br>VNDMMRFQPVKRDKEGNPINCSKANSTEYQMLQRAFAFYATDS<br>CRLSRYFTQLHLIHSDNSHLFLSRFEYDKQPNLIAFYAAYLKA<br>KLEFLNELQPQNWASDNYFLLLRAPKNDRQKLAEGWKNGFNLP<br>RGLFTEKIKTWFNEFIKTIVDISDCDIFKNRVGQVARLIPVFF<br>DKKFKDHSQPFYRYDFNVGNVSKPTEANYLSKGKREELFKSYQ<br>NKFKNNIPAEKTKEYREYKNFSLWKKFERELRLIKNQDILIWL<br>MCKNLFDEKIKPKKDILEPRIAVSYIKLDSLQTNTSTAGSLNA |

TABLE 3-continued

| | | |
|---|---|---|
| | | LAKVVPMTLAIHIDSPKPKGKAGNNEKENKEFTVYIKEEGTKL LKWGNFKTLLADRRIKGLFSYIEHDDIDLKQHPLTKRRVDLEL DLYQTCRIDIFQQTLGLEAQLLDKYSDLNTDNFYQMLIGWRKK EGIPRNIKEDTDFLKDVRNAFSHNQYPDSKKIAFRRIRKFNPK ELILEEEEGLGIATQMYKEVEKVVNRIKRIELFD |
| HMPREF9 712_03108 [*Myroides odoratimimus* CCUG 10230] (SEQ ID No. 78) | 11 | MKDILTTDTTEKQNRFYSHKIADKYFFGGYFNLASNNIYEVFE EVNKRNTFGKLAKRDNGNLKNYIIHVFKDELSISDFEKRVAIF ASYFPILETVDKKSIKERNRTIDLTLSQRIRQFREMLISLVTA VDQLRNFYTHYHHSDIVIENKVLDFLNSSFVSTALHVKDKYLK TDKTKEFLKETIAAELDILIEAYKKQIEKKNTRFKANKREDI LNAIYNEAFWSFINDKDKDKETVVAKGADAYFEKNHHKSND PDFALNISEKGIVYLLSFFLTNKEMDSLKANLTGFKGKVDRES GNSIKYMATQRIYSFHTYRGLKQKIRTSEEGVKETLLMQMIDE LSKVPNVVYQHLSTTQQNSFIEDWNEYYKDYEDDVETDDLSRV IHPVIRKRYEDRFNYFAIRFLDEFFDFPTLRFQVHLGDYVHDR RTKQLGKVESDRIIKEKVTVFARLKDINSAKASYFHSLEEQDK EELDNKWTLFPNPSYDFPKEHTLQHQGEQKNAGKIGIYVKLRD TQYKEKAALEEARKSLNPKERSATKASKYDIITQIIEANDNVK SEKPLVFTGQPIAYLSMNDIHSMLFSLLTDNAELKKTPEEVEA KLIDQIGKQINEILSKDTDTKILKKYKDNDLKETDTDKITRDL ARDKEEIEKLILEQKQRADDYNYTSSTKFNIDKSRRKHLLFN AEKGKIGVWLANDIKRFMFKESKSKWKGYQHTELQKLFAYFDT SKSDLELILSNMVMVKDYPIELIDLVKKSRTLVDFLNKYLEAR LEYIENVITRVKNSIGTPQFKTVRKECFTFLKKSNYTVVSLDK QVERILSMPLFIERGFMDDKPTMLEGKSYKQHKEKFADWFVHY KENSNYQNFYDTEVYEITTEDKREKAKVTKKIKQQQKNDVFTL MMVNYMLEEVLKLSSNDRLSLNELYQTKEERIVNKQVAKDTQE RNKNYIWNKVVDLQLCDGLVHIDNVKLKDIGNFRKYENDSRVK EFLTYQSDIVWSAYLSNEVDSNKLYVIERQLDNYESIRSKELL KEVQEIECSVYNQVANKESLKQSGNENFKQYVLQGLLPIGMDV REMLILSTDVKFKKEEIIQLGQAGEVEQDLYSLIYIRNKFAHN QLPIKEFFDFCENNYRSISDNEYYAEYYMEIFRSIKEKYAN |
| *Prevotella intermedia* (SEQ ID No. 79) | 12 | MEDDKKTTDSIRYELKDKHFWAAFLNLARHNVYITVNHINKIL EEDEINRDGYENTLENSWNEIKDINKKDRLSKLIIKHFPPFLEA TTYRQNPTDTTKQKEEKQAEAQSLESLKKSFFVFIYKLRDLRN HYSHYKHSKSLERPKFEEDLQNKMYNIFDVSIQFVKEDYKHNT DINPKKDEKHLDRKRKGKFHYSFADNEGNITESGLLFFVSLFL EKKDAIWVQKKLEGFKCSNKSYQKMTNEVFCRSRMLLPKLRLE STQTQDWILLDMLNELIRCPKSLYERLQGVNRKKFYVSFDPAD EDYDAEQEPEKNTLVRHQDREPYFALRYEDYNEVEANLREQID LGTYHFSIYKKLIGGQKEDRHLTHKLYGFERIQEEDKQNRPDE WKAIVKDSDTFKKKEEKEEKPYISETTPHYHLENKKIGIAFK NHNIWPSTQTELTNNKRKKYNLGTSIKAEAFLSVHELLPMMFY YLLLKTENTKNDNKVGGKKETKKQGKHKIEAIIESKIKDIYAL YDAFANGEINSEDELKEYLKGKDIKIVHLPKQMIAILKNEHKD MAEKAEAKQEKMKLATENRLKTLDKQLKGKIQNGKRYNSAPKS GEIASWLVNDMMREQPVQKDENGESLNNSKANSTEYQLLQRTL AFFGSEHERLAPYFKQTKLIESSNPHPFLNDTEWEKCSNILSF YRSYLKARKNFLESLKPEDWEKNQYFLMLKEPKTNRETLVQGW KNGFNLPRGFFTEPIRKWFMEHWKSIKVDDLKRVGLVAKVTPL FFSEKYKDSVQPEYNYPENVGDVNKPKEEDELHREERIELWDK KKDKEKGYKAKKKFKEMTDKEKEEHRSYLEFQSWNKFERELRL VRNQDIVTWLLCTELIDKLKIDELNIKELKKLRLKDINTDTAK KEKNNILNRVMPMELPVTVYKVNKGGYIIKNKPLHTIYIKEAE TKLLKQGNFKALVKDRRLNGLFSFVKTPSEAESESNPISKLRV EYELGKYQNARLDIIEDMLALEKKLIDKYNSLDTDNFHNMLTG WLELKGEAKKARFQNDVKLLTAVRNAFSHNQYPMYDENLFGNI ERFSLSSSNIIESKGLDIAAKLKEEVSKAAKKIQNEEDNKKEK ET |
| *Capnocytophaga canimorsus* (SEQ ID No. 80) | 13 | MKNIQRLGKGNEFSPEKKEDKEYEGGFLNLANNNIEDFFKEII TRFGIVITDENKKPKETFGEKILNEIFKKDISIVDYEKWVNIF ADYFPFTKYLSLYLEEMQEKNRVICERDVMKELLKTVEALRNF YTHYDHEPIKIEDRVEYELDKVLLDVSLTVKNKYLKTDKTKEE LNQHIGEELKELCKQRKDYLVGKGKRIDKESEIINGIYNNAFK DFICKREKQDDKENHNSVEKILCNKEPQNKKQKSSATVWELCS KSSSKYTEKSFPNRENDKHCLEVPISQKGIVFLLSEELNKGEI YALTSNIKGFKAKITKEEPVTYDKNSIRYMATHRMFSFLAYKG LKRKIRTSEINYNEDGQASSTYEKETLMLQMLDELNKVPDVVY QNLSEDVQKTFIEDWNEYLKENNGDVGTMEEEQVIHPVIRKRY EDKENYFAIRELDEFAQPFTLRFQVHLGNYLCDKRTKQICDTT TEREVKKKITVFGRLSELENKKAIFLNEREEIKGWEVFPNPSY DFPKENISVNYKDFPIVGSILDREKQPVSNKIGIRVKIADELQ REIDKAIKEKKLRPNKNRKANQDEKQKERLVNEIVSTNSNEQG EPVVFIGQPTAYLSMNDIHSVLYEFLINKISGEALETKIVEKI ETQIKQIIGKDATTKILKPYTNANSNSINREKLLRDLEQEQQI LKTLLEEQQQREKDKKDKKSKRKHELYPSEKGKVAVWLANDIK RFMPKAFKEQWRGYHHSLLQKYLAYYEQSKEELKNLLPKEVFK |

TABLE 3-continued

| | | |
|---|---|---|
| | | HFPFKLKGYFQQQYLNQFYTDLKRRLSYVNELLLNIQNFKND
KDALKATEKECPKFFRKQNYIINPINIQISILVYPIFLKRGF
LDEKPTMIDREKFKENKDTELADWFMHYKNYKEDNYQKFYAYP
LEKVEEKEKFKRNKQINKQKKNDVYTLMMVEYIIQKIFGDKFV
EENPLVLKGIFQSKAERQQNNTHAATTQERNLNGILNQPKDIK
IQGKITVKGVKLKDIGNFRKYEIDQRVNTFLDYEPRKEWMAYL
PNDWKEKEKQGQLPPNNVIDRQISKYETVRSKILLKDVQELEK
IISDEIKEEHRHDLKQGKYYNFKYYILNGLLRQLKNENVENYK
VFKLNTNPEKVNITQLKQEATDLEQKAFVLTYIRNKFAHNQLP
KKEFWDYCQEKYGKIEKEKTYAEYFAEVFKREKEALIK |
| *Porphyromonas gulae* (SEQ ID No. 81) | 14 | MTEQSERPYNGTYYTLEDKHFWAAFLNLARHNAYITLTHIDRQ
LAYSKADITNDQDVLSFKALWKNFDNDLERKSRLRSLILKHFS
FLEGAAYGKKLFESKSSGNKSSKNKELTKKEKEELQANALSLD
NLKSILFDFLQKLKDFRNYYSHRYHSGSSELPLFDGNMLQRLY
NVFDVSVQRVKIDHEHNDEVDPHYHFNHLVRKGKKDRYGHNDN
PSFKHHFVDGEGMVTEAGLLFFVSLFLEKRDAIWMQKKIRGFK
GGTETYQQMTNEVFCRSRISLPKLKLESLRMDDWMLLDMLNEL
VRCPKPLYDRLREDDRACFRVPVDILPDEDDTDGGGEDPFKNT
LVRHQDRFPYFALRYFDLKKVFTSLRFHIDLGTYHFAIYKKMI
GEQPEDRHLTRNLYGFGRIQDFAEEHRPEEWKRLVRDLDYFET
GDKPYISQTSPHYHIEKGKIGLRFMPEGQHLWPSPEVGTTRTG
RSKYAQDKRLTAEAFLSVHELMPMMFYYFLLREKYSEEVSAER
VQGRIKRVIEDVYAVYDAFARDEINTRDELDACLADKGIRRGH
LPRQMIAILSQEHKDMEEKIRKKLQEMMADTDHRLDMLDRQTD
RKIRIGRKNAGLPKSGVIADWLVRDMMRFQPVAKDASGKPLNN
SKANSTEYRMLQRALALFGGEKERLTPYFRQMNLTGGNNPHPF
LHETRWESHTNILSFYRSYLRARKAFLERIGRSDRVENRPFLL
LKEPKTDRQTLVAGWKGEFHLPRGIFTEAVRDCLIEMGHDEVA
SYKEVGFMAKAVPLYFERACEDRVQPFYDSPFNVGNSLKPKKG
RFLSKEERAEEWERGKERFRDLEAWSYSAARRIEDAFAGIEYA
SPGNKKKIEQLLRDLSLWEAFESKLKVRADRINLAKLKKEILE
AQEHPYHDFKSWQKFERELRLVKNQDIITWMMCRDLMEENKVE
GLDTGTLYLKDIRPNVQEQGSLNVLNRVKPMRLPVVVYRADSR
GHVHKEEAPLATVYIEERDTKLLKQGNFKSFVKDRRLNGLFSF
VDTGGLAMEQYPISKLRVEYELAKYQTARVCVFELTLRLEESL
LTRYPHLPDESFREMLESWSDPLLAKWPELHGKVRLLIAVRNA
FSHNQYPMYDEAVFSSIRKYDPSSPDAIEERMGLNIAHRLSEE
VKQAKETVERIIQA |
| *Prevotella sp.* P5-125 (SEQ ID No. 82) | 15 | MNIPALVENQKKYFGTYSVMAMLNAQTVLDHIQKVADIEGEQN
ENNENLWFHPVMSHLYNAKNGYDKQPEKTMFIIERLQSYFPFL
KIMAENQREYSNGKYKQNRVEVNSNDIFEVLKRAFGVLKMYRD
LTNHYKTYEEKLNDGCEFLTSTEQPLSGMINNYYTVALRNMNE
RYGYKTEDLAFIQDKRFKFVKDAYGKKKSQVNTGFFLSLQDYN
GDTQKKLHLSGVGIALLICLFLDKQYINIFLSRLPIFSSYNAQ
SEERRIIIRSFGINSIKLPKDRIHSEKSNKSVAMDMLNEVKRC
PDELFTTLSAEKQSRFRIISDDHNEVLMKRSSDRFVPLLLQYI
DYGKLFDHIRFHVNMGKLRYLLKADKTCIDGQTRVRVIEQPLN
GFGRLEEAETMRKQENGTFGNSGIRIRDFENMKRDDANPANYP
YIVDTYTHYILENNKVEMFINDKEDSAPLLPVIEDDRYVVKTI
PSCRMSTLEIPAMAFHMFLFGSKKTEKLIVDVHNRYKRLFQAM
QKEEVTAENIASFGIAESDLPQKILDLISGNAHGKDVDAFIRL
TVDDMLTDTERRIKRFKDDRKSIRSADNKMGKRGFKQISTGKL
ADFLAKDIVLFQPSVNDGENKITGLNYRIMQSAIAVYDSGDDY
EAKQQFKLMFEKARLIGKTTEPHPFLYKVFARSIPANAVEFY
ERYLIERKFYLTGLSNEIKKGNRVDVPFIRRDQNKWKTPAMKT
LGRIYSEDLPVELPRQMFDNEIKSHLKSLPQMEGIDFNNANVT
YLIAEYMKRVLDDDFQTFYQWNRNYRYMDMLKGEYDRKGSLQH
CFTSVEEREGLWKERASRTERYRKQASNKIRSNRQMRNASSEE
IETILDKRLSNSRNEYQKSEKVIRRYRVQDALLFLLAKKTLTE
LADPDGERFKLKEIMPDAEKGILSEIMPMSFTFEKGGKKYTIT
SEGMKLKNYGDFFVLASDKRIGNLLELVGSDIVSKEDIMEEFN
KYDQCRPEISSIVFNLEKWAFDTYPELSARVDREEKVDFKSIL
KILLNNKNINKEQSDILRKIRNAFDHNNYPDKGVVEIKALPEI
AMSIKKAFGEYAIMK |
| *Flavobacterium branchiophilum* (SEQ ID No. 83) | 16 | MENLNKILDKENEICISKIFNTKGIAAPITEKALDNIKSKQKN
DLNKEARLHYFSIGHSFKQIDTKKVFDYVLIEELKDEKPLKFI
TLQKDFFTKEFSIKLQKLINSIRNINNHYVHNFNDINLNKIDS
NVPHFLKESFELAIIEKYYKVNKKYPLDNEIVLFLKELFIKDE
NTALLNYFTNLSKDEAIEYILTFTITENKIWINNEHNILNIE
KGKYLTFEAMLFLITIFLYKNEANHLLPKLYDFKNNKSQELF
TFFSKKFTSQDIDAEEEGHLIKFRDMIQYLNHYPTAWNNDLKLE
SENKNKIMTTKLIDSIIEFELNSNYPSFATDIQFKKEAKAFLF
ASNKKRNQTSFSNKSYNEEIRHNPHIKQYRDEIASALTPISFN
VKEDKFKIFVKKHVLEEYFPPNSIGYEKFLEYNDFTEKEKEDFG
LKLYSNPKTNKLIERIDNHKLVKSHGRNQDRFMDFSMRFLAEN
NYFGKDAFFKCYKFYDTQEQDEFLQSNENNDDVKFHKGKVTTY
IKYEEHLKNYSYWDCPFVEENNSMSVKISIGSEEKILKIQRNL |

TABLE 3-continued

| | | |
|---|---|---|
| | | MIYFLENALYNENVENQGYKLVNNYYRELKKDVEESIASLDLI<br>KSNPDFKSKYKKILPKRLLHNYAPAKQDKAPENAFETLLKKAD<br>FREEQYKKLLKKAEHEKNKEDFVKRNKGKQFKLHFIRKACQMM<br>YFKEKYNTLKEGNAAFEKKDPVIEKRKNKEHEFGHHKNLNITR<br>EEFNDYCKWMFAFNGNDSYKKYLRDLFSEKHFFDNQEYKNLFE<br>SSVNLEAFYAKTKELFKKWIETNKPTNNENRYTLENYKNLILQ<br>KQVFINVYHFSKYLIDKNLLNSENNVIQYKSLENVEYLISDFY<br>FQSKLSIDQYKTCGKLFNKLKSNKLEDCLLYEIAYNYIDKKNV<br>HKIDIQKILTSKIILTINDANTPYKISVPFNKLERYTEMIAIK<br>NQNNLKARFLIDLPLYLSKNKIKKGKDSAGYEIIIKNDLEIED<br>INTINNKIINDSVKFTEVLMELEKYFILKDKCILSKNYIDNSE<br>IPSLKQFSKVWIKENENEIINYRNIACHPHLPLLETFDNLLLN<br>VEQKFIKEELQNVSTINDLSKPQEYLILLFIKFKHNNFYLNLF<br>NKNESKTIKNDKEVKKNRVLQKFINQVILKKK |
| Myroides<br>odoratimimus<br>(SEQ ID<br>No. 84) | 17 | MKDILTTDTTEKQNRFYSHKIADKYFFGGYFNLASNNIYEVFE<br>EVNKRNTFGKLAKRDNGNLKNYIIHVFKDELSISDFEKRVAIF<br>ASYFPILETVDKKSIKERNRTIDLTLSQRIRQFREMLISLVTA<br>VDQLRNFYTHYHHSDIVIENKVLDFLNSSFVSTALHVKDKYLK<br>TDKTKEFLKETIAAELDILIEAYKKKQIEKKNTRFKANKREDI<br>LNAIYNEAFWSFINDKDKDKETVVAKGADAYFEKNHHKSND<br>PDFALNISEKGIVYLLSFFLTNKEMDSLKANLTGFKGKVDRES<br>GNSIKYMATQRIYSFHTYRGLKQKIRTSEEGVKETLLMQMIDE<br>LSKVPNVVYQHLSTTQQNSFIEDWNEYYKDYEDDVETDDLSRV<br>THPVIRKRYEDRFNYFAIRFLDEFFDFPTLRFQVEILGDYVHD<br>RRTKQLGKVESDRIIKEKVTVFARLKDINSAKASYFHSLEEQD<br>KEELDNKWTLFPNPSYDFPKEHTLQHQGEQKNAGKIGIYVKLR<br>DTQYKEKAALEEARKSLNPKERSATKASKYDIITQIIEANDNV<br>KSEKPLVFTGQPIAYLSMNDIHSMLFSLLTDNAELKKTPEEVE<br>AKLIDQIGKQINEILSKDTDTKILKKYKDNDLKETDTDKITRD<br>LARDKEEIEKLILEQKQRADDYNYTSSTKFNIDKSRKRKHLLF<br>NAEKGKIGVWLANDIKRFMEKESKSKWKGYQHIELQKLFAYFD<br>TSKSDLELILSNMVMVKDYPIELIDLVKKSRTLVDFLNKYLEA<br>RLEYIENVITRVKNSIGTPQFKTVRKECFTFLKKSNYTVVSLD<br>KQVERILSMPLFIERGFMDDKPTMLEGKSYKQHKEKFADWFVH<br>YKENSNYQNFYDTEVYEITTEDKREKAKVTKKIKQQQKNDVFT<br>LMMVNYMLEEVLKLSSNDRLSLNELYQTKEERIVNKQVAKDTQ<br>ERNKNYIWNKVVDLQLCDGLVHIDNVKLKDIGNFRKYENDSRV<br>KEFLTYQSDIVWSAYLSNEVDSNKLYVIERQLDNYESIRSKEL<br>LKEVQEIECSVYNQVANKESLKQSGNENFKQYVLQGLLPIGMD<br>VREMLILSTDVKFKKEEIIQLGQAGEVEQDLYSLIYIRNKFAH<br>NQLPIKEFFDFCENNYRSISDNEYYAEYYMEIFRSIKEKYAN |
| Flavobacterium<br>columnare<br>(SEQ ID<br>No. 85) | 18 | MSSKNESYNKQKTFNHYKQEDKYFFGGFLNNADDNLRQVGKEF<br>KTRINFNRNNNELASVFKDYFNKEKSVAKREHALNLLSNYFPV<br>LERIQKHTNHNFEQTREIFELLLDTIKKLRDYYTHHYHKPITI<br>NPKIYDFLDDTLLDVLITIKKKKVKNDTSRELLKEKLRPELTQ<br>LKNQKREELIKKGKKLLEENLENAVFNHCLIPFLEENKTDDKQ<br>NKTVSLRKYRKSKPNEETSITLTQSGLVFLMSFFLHRKEFQVF<br>TSGLERFKAKVNTIKEEEISLNKNNIVYMITHWSYSYYNFKGL<br>KHRIKTDQGVSTLEQNNTTHSLTNTNTKEALLTQIVDYLSKVP<br>NEIYETLSEKQQKEFEEDINEYMRENPENEDSTFSSIVSHKVI<br>RKRYENKFNYFAMRFLDEYAELPTLRFMVNFGDYIKDRQKKIL<br>ESIQFDSERIIKKEIHLFEKLSLVTEYKKNVYLKETSNIDLSR<br>FPLFPNPSYVMANNNIPFYIDSRSNNLDEYLNQKKKAQSQNKK<br>RNLTFEKYNKEQSKDAIIAMLQKEIGVKDLQQRSTIGLLSCNE<br>LPSMLYEVIVKDIKGAELENKIAQKIREQYQSIRDFTLDSPQK<br>DNIPTTLIKTINTDSSVTFENQPIDIPRLKNALQKELTLTQEK<br>LLNVKEHEIEVDNYNRNKNTYKFKNQPKNKVDDKKLQRKYVFY<br>RNEIRQEANWLASDLIHFMKNKSLWKGYMHNELQSFLAFFEDK<br>KNDCIALLETVFNLKEDCILTKGLKNLFLKHGNFIDFYKEYLK<br>LKEDFLSTESTFLENGFIGLPPKILKKELSKRLKYIFIVFQKR<br>QFIIKELEEKKNNLYADAINLSRGIFDEKPTMIPFKKPNPDEF<br>ASWFVASYQYNNYQSFYELTPDIVERDKKKKYKNLRAINKVKI<br>QDYYLKLMVDTLYQDLFNQPLDKSLSDFYVSKAEREKIKADAK<br>AYQKLNDSSLWNKVIHLSLQNNRITANPKLKDIGKYKRALQDE<br>KIATLLTYDARTWTYALQKPEKENENDYKELHYTALNMELQEY<br>EKVRSKELLKQVQELEKKILDKFYDFSNNASHPEDLEIEDKKG<br>KRHPNFKLYITKALLKNESEIINLENIDIEILLKYYDYNTEEL<br>KEKIKNMDEDEKAKIINTKENYNKITNVLIKKALVLIIIRNKM<br>AHNQYPPKFIYDLANRFVPKKEEEYFATYFNRVFETITKELWE<br>NKEKKDKTQV |
| Porphyromonas<br>gingivalis<br>(SEQ ID<br>No. 86) | 19 | MTEQNEKPYNGTYYTLEDKHFWAAFLNLARHNAYITLAHIDRQ<br>LAYSKADITNDEDILFFKGQWKNLDNDLERKARLRSLILKHFS<br>FLEGAAYGKKLFESQSSGNKSSKKKELSKKEKEELQANALSLD<br>NLKSILFDFLQKLKDFRNYYSHYRHPESSELPLFDGNMLQRLY<br>NVFDVSVQRVKRDHEHNDKVDPRHRFNHLVRKGKKDKYGNNDN<br>PFFKHHFVDREGTVTEAGLLFFVSLFLEKRDAIWMQKKIRGFK<br>GGTEAYQQMTNEVFCRSRISLPKLKLESLRTDDWMLLDMLNEL |

TABLE 3-continued

| | | |
|---|---|---|
| | | VRCPKSLYDRLREEDRARFRVPVDILSDEDDTDGTEEDPFKNT
LVRHQDRFPYFALRYFDLKKVFTSLRFHIDLGTYHFAIYKKNI
GEQPEDRHLTRNLYGFGRIQDFAEEHRPEEWKRLVRDLDYFET
GDKPYITQTTPHYHIEKGKIGLRFVPEGQHLWPSPEVGATRTG
RSKYAQDKRLTAEAFLSVHELMPMMFYYFLLREKYSEEVSAEK
VQGRIKRVIEDVYAVYDAFARDEINTRDELDACLADKGIRRGH
LPRQMIAILSQEHKDMEEKVRKKLQEMIADTDHRLDMLDRQTD
RKIRIGRKNAGLPKSGVVADWLVRDMMRFQPVAKDTSGKPLNN
SKANSTEYRMLQRALALFGGEKERLTPYFRQMNLTGGNNPHPF
LHETRWESHTNILSFYRSYLEARKAFLQSIGRSDRVENHRFLL
LKEPKTDRQTLVAGWKGEFHLPRGIFTEAVRDCLIEMGYDEVG
SYKEVGFMAKAVPLYFERASKDRVQPFYDYPFNVGNSLKPKKG
RFLSKEKRAEEWESGKERFRLAKLKKEILEAKEHPYHDFKSWQ
KFERELRLVKNQDIITWMMCRDLMEENKVEGLDTGTLYLKDIR
TDVQEQGSLNVLNRVKPMRLPVVVYRADSRGHVHKEQAPLATV
YIEERDTKLLKQGNFKSFVKDRRLNGLFSFVDTGALAMEQYPI
SKLRVEYELAKYQTARVCAFEQTLELEESLLTRYPHLPDKNFR
KMLESWSDPLLDKWPDLHGNVRLLIAVRNAFSHNQYPMYDETL
FSSIRKYDPSSPDAIEERMGLNIAHRLSEEVKQAKEMVERIIQ
A |
| Porphyromonas
sp.
COT-052
OH4946
(SEQ ID
No. 87) | 20 | MTEQSERPYNGTYYTLEDKHFWAAFLNLARHNAYITLTHIDRQ
LAYSKADITNDQDVLSFKALWKNFDNDLERKSRLRSLILKHFS
FLEGAAYGKKLFESKSSGNKSSKNKELTKKEKEELQANALSLD
NLKSILFDFLQKLKDFRNYYSHYRHSESSELPLFDGNMLQRLY
NVFDVSVQRVKRDHEHNDKVDPHRHFNHLVRKGKKDRYGHNDN
PSPFKHHFVDSEGMVTEAGLLFFVSLFLEKRDAIWMQKKIRGFK
GGTETYQQMTNEVFCRSRISLPKLKLESLRTDDWMLLDMLNEL
VRCPKPLYDRLREDDRACFRVPVDILPDEDDTDGGGEDPFKNT
LVRHQDRFPYFALRYFDLKKVFTSLRFHIDLGTYHFAIYKKMI
GEQPEDRHLTRNLYGFGRIQDFAEEHRPEEWKRLVRDLDYFET
GDKPYISQTTPHYHIEKGKIGLRFVPEGQHLWPSPEVGTTRTG
RSKYAQDKRLTAEAFLSVHELMPMMFYYFLLREKYSEEVSAEK
VQGRIKRVIEDVYAIYDAFARDEINTLKELDACLADKGIRRGH
LPKQMIGILSQERKDMEEKVRKKLQEMIADTDHRLDMLDRQTD
RKIRIGRKNAGLPKSGVIADWLVRDMMRFQPVAKDTSGKPLNN
SKANSTEYRMLQRALALFGGEKERLTPYFRQMNLTGGNNPHPF
LHETRWESHTNILSFYRSYLRARKAFLERIGRSDRVENCPFLL
LKEPKTDRQTLVAGWKGEFHLPRGIFTEAVRDCLIEMGYDEVG
SYREVGFMAKAVPLYFERACEDRVQPFYDSPFNVGNSLKPKKG
RFLSKEDRAEEWERGKERFRDLEAWSHSAARRIKDAFAGIEYA
SPGNKKKIEQLLRDLSLWEAFESKLKVRADKINLAKLKKEILE
AQEHPYHDFKSWQKFERELRLVKNQDIITWMMCRDLMEENKVE
GLDTGTLYLKDIRPNVQEQGSLNVLNRVKPMRLPVVVYRADSR
GHVHKEEAPLATVYIEERDTKLLKQGNFKSFVKDRRLNGLFSF
VDTGGLAMEQYPISKLRVEYELAKYQTARVCVFELTLRLEESL
LSRYPHLPDESFREMLESWSDPLLAKWPELHGKVRLLIAVRNA
FSHNQYPMYDEAVFSSIRKYDPSSPDAIEERMGLNIAHRLSEE
VKQAKETVERIIQA |
| Prevotella
intermedia
(SEQ ID
No. 88) | 21 | MEDDKKTKESTNMLDNKHFWAAFLNLARHNVYITVNHINKVLE
LKNKKDQDIIIDNDQDILAIKTHWEKVNGDLNKTERLRELMTK
HFPFLETAIYTKNKEDKEEVQKEKQAKAQSFDSLKHCLFLFLE
KLQEARNYYSHYKYSESTKEPMLEKELLKKMYNIFDDNIQLVI
KDYQHNKDINPDEDFKHLDRTEEEFNYYFTTNKKGNITASGLL
FFVSLFLEKKDAIWMQQKLRGFKDNRESKKKMTHEVFCRSRML
LPKLRLESTQTQDWILLDMLNELIRCPKSLYERLQGEYRKKFN
VPFDSADEDYDAEQEPPFKNTLVRHQDRFPYFALRYFDYNEIFT
NLRFQIDLGTYHFSIYKKLIGGQKEDRHLTHKLYGFERIQEFA
KQNRTDEWKAIVKDFDTYETSEEPYISETAPHYHLENQKIGIR
FRNDNDEIWPSLKTNGENNEKRKYKLDKQYQAEAFLSVHELLP
MMFYYLLLKKEEPNNDKKNASIVEGFIKREIRDIYKLYDAFAN
GEINNIDDLEKYCEDKGIPKRHLPKQMVAILYDEHKDMAEEAK
RKQKEMVKDTKKLLATLEKQTQGEIEDGGRNIRLLKSGEIARW
LVNDMMRFQPVQKDNEGNPLNNSKANSTEYQMLQRSLALYNKE
EKPTRYFRQVNLINSSNPHPFLKWTKWEECNNILSFYRSYLTK
KIEFLNKLKPEDWEKNQYFLKLKEPKTNRETLVQGWKNGFNLP
RGIFTEPIREWFKRHQNDSEEYEKVETLDRVGLVTKVIPLFFK
KEDSKDKEEYLKKDAQKEINNCVQPFYGPPYNVGNIHKPDEKD
FLPSEERKKLWGDKKYKFKGYKAKVKSKKLTDKEKEEYRSYLE
FQSWNKFERELRLVRNQDIVTWLLCTELIDKLKVEGLNVEELK
KLRLKDIDTDTAKQEKNNILNRVMPMQLPVTVYEIDDSHNIVK
DRPLHTVYIEETKTKLLKQGNFKALVKDRRLNGLFSFVDTSSE
TELKSNPISKSLVEYELGEYQNARIETIKDMLLLEETLIEKYK
TLPTDNFSDMLNGWLEGKDEADKARFQNDVKLLVAVRNAFSHN
QYPMRNRIAFANINPFSLSSADTSEEKKLDIANQLKDKTHKII
KRIIEIEKPIETKE |
| PIN17_0200
[Prevotella | AFJ07523 | MKMEDDKKTKESTNMLDNKHFWAAFLNLARHNVYITVNHINKV
LELKNKKDQDIIIDNDQDILAIKTHWEKVNGDLNKTERLRELM |

TABLE 3-continued

| | | |
|---|---|---|
| intermedia 17](SEQ ID No. 89) | | TKHPPFLETAIYTKNKEDKEEVKQEKQAKAQSFDSLKHCLFLF<br>LEKLQEARNYYSHYKYSESTKEPMLEKELLKKMYNIFDDNIQL<br>VIKDYQHNKDINPDEDFKHLDRTEEEFNYYFTTNKKGNITASG<br>LLFFVSLFLEKKDAIWMQQKLRGFKDNRESKKKMTHEVFCRSR<br>MLLPKLRLESTQTQDWILLDMLNELIRCPKSLYERLQGEYRKK<br>FNVPFDSADEDYDAEQEPPFKNTLVRHQDRFPYFALRYFDYNEI<br>FTNLRFQIDLGTYHFSIYKKLIGGQKEDRHLTHKLYGFERIQE<br>FAKQNRTDEWKAIVKDFDTYETSEEPYISETAPHYHLENQKIG<br>IRFRNDNDEIWPSLKTNGENNEKRKYKLDKQYQAEAFLSVHEL<br>LPMMFYYLLLKKEEPNNDKKNASIVEGFIKREIRDIYKLYDAF<br>ANGEINNIDDLEKYCEDKGIPKRHLPKQMVAILYDEHKDMAEE<br>AKRKQKEMVKDTKKLLATLEKQTQGEIEDGGRNIRLLKSGEIA<br>RWLVNDMA4RFQPVQKDNEGNPLNNSKANSTEYQMLQRSLALY<br>NKEEKPTRYFRQVNLINSSNPHPFLKWTKWEECNNILSFYRSY<br>LTKKIEFLNKLKPEDWEKNQYFLKLKEPKTNRETLVQGWKNGF<br>NLPRGIFTEPIREWFKRHQNDSEEYEKVETLDRVGLVTKVIPL<br>FFKKEDSKDKEEYLKKDAQKEINNCVQPFYGFPYNVGNIHKPD<br>EKDFLPSEERKKLWGDKKYKFKGYKAKVKSKKLTDKEKEEYRS<br>YLEFQSWNKFERELRLVRNQDIVTWLLCTELIDKLKVEGLNVE<br>ELKKLRLKDIDTDTAKQEKNNILNRVMPMQLPVTVYEIDDSHN<br>IVKDRPLHTVYIEETKTKLLKQGNFKALVKDRRLNGLFSFVDT<br>SSETELKSNPISKSLVEYELGEYQNARIETIKDMLLLEETLIE<br>KYKTLPTDNFSDMLNGWLEGKDEADKARFQNDVKLLVAVRNAF<br>SHNQYPMRNRIAFANINPFSLSSADTSEEKKLDIANQLKDKTH<br>KIIKRIIEIEKPIETKE |
| Prevotella intermedia (SEQ ID No. 90) | BAU18623 | MEDDKKTTDSISYELKDKHFWAAFLNLARHNVYITVNHINKVL<br>ELKNKKDQDIIIDNDQDILAIKTHWEKVNGDLNKTERLRELMT<br>KHPPFLETAIYSKNKEDKEEVKQEKQAKAQSFDSLKHCLFLFL<br>EKLQETRNYYSHYKYSESTKEPMLEKELLKKMYNIFDDNIQLV<br>IKDYQHNKDINPDEDFKHLDRTEEDFNYYFTRNKKGNITESGL<br>LFFVSLFLEKKDAIWMQQKLRGFKDNRESKKKMTHEVFCRSRM<br>LLPKLRLESTQTQDWILLDMLNELIRCPKSLYERLQGEDREKE<br>KVPFDPADEDYDAEQEPEKNTLVRHQDREPYFALRYEDYNEIF<br>TNLRFQIDLGTEHFSIYKKLIGGQKEDRHLTHKLYGFERIQEF<br>AKQNRPDEWKAIVKDLDTYETSNERYISETTPHYHLENQKIGI<br>RERNDNDEIWPSLKTNGENNEKSKYKLDKQYQAEAFLSVHELL<br>PMMFYYLLLKKEEPNNDKKNASIVEGFIKREIRDMYKLYDAFA<br>NGEINNIDDLEKYCEDKGIPKRHLPKQMVAILYDEHKDMVKEA<br>KRKQRKMVKDTEKLLAALEKQTQEKTEDGGRNIRLLKSGEIAR<br>WLVNDMMRFQPVQKDNEGNPLNNSKANSTEYQMLQRSLALYNK<br>EEKPTRYFRQVNLINSSNPHPFLKWTKWEECNNILSFYRSYLT<br>KKIEFLNKLKPEDWEKNQYFLKLKEPKTNRETLVQGWKNGENL<br>PRGIFTEPIREWFKRHQNDSKEYEKVEALDRVGLVTKVIPLFF<br>KKEDSKDKEEDLKKDAQKEINNCVQPFYSEPYNVGNIHKPDEK<br>DELHREERIELWDKKKDFKGYKAKVKSKKLTDKEKEEYRSYL<br>EFQSWNKFERELRLVRNQDIVTWLLCTELIDKLKVEGLNVEEL<br>KKLRLKDIDTDTAKQEKNNILNRVMPMQLPVTVYEIDDSHNIV<br>KDRPLHTVYIEETKTKLLKQGNEKALVKDRRLNGLESFVDTSS<br>EAELKSNPISKSLVEYELGEYQNARIETIKDMLLLEETLIEKY<br>KNLPTDNFSDMLNGWLEGKDEADKARFQNDVKLLVAVRNAFSH<br>NQYPMRNRIAFANINPFSLSSADTSEEKKLDIANQLKDKTHKI<br>IKRIIEIEKPIETKE |
| HMPREF6485_0083 [Prevotella buccae ATCC 33574] (SEQ ID No. 91) | EFU31981 | MQKQDKLEVDRKKNAIFAFPKYITIMENKEKPEPIYYELTDKH<br>FWAAFLNLARHNVYTTINHINRRLEIAELKDDGYMMGIKGSWN<br>EQAKKLDKKVRLRDLIMKHFPFLEAAAYEMTNSKSPNNKEQRE<br>KEQSEALSLNNLKNVLFIFLEKLQVLRNYYSHYKYSEESPKPI<br>FETSLLKNMYKVFDANVRLVKRDYMHHENIDMQRDFTHLNRKK<br>QVGRTKNIIDSPNEHYHFADKEGNMTIAGLLEFVSLELDKKDA<br>IWMQKKLKGFKDGRNLREQMTNEVFCRSRISLPKLKLENVQTK<br>DWMQLDMLNELVRCPKSLYERLREKDRESEKVPFDIFSDDYNA<br>EEEPEKNTLVRHQDREPYEVLRYEDLNEIFEQLREQIDLGTYH<br>FSIYNKRIGDEDEVRHLTHHLYGEARIQDFAPQNQPEEWRKLV<br>KDLDHFETSQEPYISKTAPHYHLENEKIGIKFCSAHNNLFPSL<br>QTDKTCNGRSKFNLGTQFTAEAFLSVHELLPMMFYYLLLTKDY<br>SRKESADKVEGIIRKEISNIYAIYDAFANNEINSIADLTRRLQ<br>NTNILQGHLPKQMISILKGRQKDMGKEAERKIGEMIDDTQRRL<br>DLLCKQTNQKIRIGKRNAGLLKSGKIADWLVNDMMRFQPVQKD<br>QNNIPINNSKANSTEYRMLQRALALFGSENFRLKAYFNQMNLV<br>GNDNPHPFLAETQWEHQTNILSFYRNYLEARKKYLKGLKPQNW<br>KQYQHFLILKVQKTNRNTLVTGWKNSFNLPRGIFTQPIREWFE<br>KHNNSKRIYDQILSFDRVGFVAKAIPLYFAEEYKDNVQPFYDY<br>PFNIGNRLKPKKRQFLDKKERVELWQKNKELFKNYPSEKKKTD<br>LAYLDFLSWKKFERELRLIKNQDIVTWLMFKELFNMATVEGLK<br>IGEIHLRDIDTNTANEESNNILNRIMPMKLPVKTYETDNKGNI<br>LKERPLATFYIEETETKVLKQGNFKALVKDRRLNGLFSFAETT<br>DLNLEEHPISKLSVDELIKYQTTRISIFEMTLGLEKKLIDKY |

TABLE 3-continued

| | | |
|---|---|---|
| | | STLPTDSFRNMLERWLQCKANRPELKNYVNSLIAVRNAFSHNQ YPMYDATLFAEVKKFTLFPSVDTKKIELNIAPQLLEIVGKAIK EIEKSENKN |
| HMPREF9144_1146 [*Prevotella pallens* ATCC 700821] (SEQ ID No. 92) | EGQ18444 | MKEEEKGKTPVVSTYNKDDKHFWAAFLNLARHNVYITVNHINK ILGEGEINRDGYENTLEKSWNEIKDINKKDRLSKLIIKHFPFL EVTTYQRNSADTTKQKEEKQAEAQSLESLKKSFFVFIYKLRDL RNHYSHYKHSKSLERPKFEEDLQEKMYNIFDASIQLVKEDYHK NTDIKTEEDFKHLDRKGQFKYSFADNEGNITESGLLFFVSLFL EKKDAIWVQKKLEGFKCSNESYQKMTNEVFCRSRMLLPKLRLQ STQTQDWILLDMLNELIRCPKSLYERLREEDRKKFRVPIEIAD EDYDAEQEPFKNALVRHQDRFPYFALRYFDYNEIFTNLRFQID LGTYHFSIYKKQIGDYKESHHLTHKLYGFERIQEFTKQNRPDE WRKFVKTFNSFETSKEPYIPETTPHYHLENQKIGIRFRNDNDK IWPSLKTNSEKNEKSKYKLDKSFQAEAFLSVHELLPMMFYYLL LKTENTDNDNEIETKKKENKNDKQEKHKIEEIIENKITEIYAL YDAFANGKINSIDKLEEYCKGKDIEIGHLPKQMIAILKSEHKD MATEAKRKQEEMLADVQKSLESLDNQINEEIENVERKNSSLKS GEIASWLVNDMMRFQPVQKDNEGNPLNNSKANSTEYQMLQRSL ALYNKEEKPTRYFRQVNLIESSNPHPFLNNTEWEKCNNILSFY RSYLEAKKNFLESLKPEDWEKNQYFLMLKEPKTNCETLVQGWK NGFNLPRGIFTEPIRKWFMEHRKNITVAELKRVGLVAKVIPLF FSEEYKDSVQPFYNYLFNVGNINKPDEKNFLNCEERRELLRKK KDEFKKMTDKEKEENPSYLEFQSWNKFERELRLVRNQDIVTWL LCMELFNKKKIKELNVEKIYLKNINTNTTKKEKNTEEKNGEEK IIKEKNNILNRIMPMRLPIKVYGRENFSKNKKKKIRRNTFFTV YIEEKGTKLLKQGNFKALERDRRLGGLFSFVKTHSKAESKSNT ISKSRVEYELGEYQKARIEIIKDMLALEETLIDKYNSLDTDNF HNMLTGWLKLKDEPDKASFQNDVDLLIAVRNAFSHNQYPMRNR IAFANINPFSLSSANTSEEKGLGIANQLKDKTHKTIEKIIEIE KPIETKE |
| HMPREF9714_02132 [*Myroides odoratimimus* CCUG12901] (SEQ ID No. 93) | EHO08761 | MKDILTTDTTEKQNRFYSHKIADKYFFGGYFNLASNNIYEVFE EVNKRNTFGKLAKRDNGNLKNYIIHVFKDELSISDFEKRVAIF ASYFPILETVDKKSIKERNRTIDLTLSQRIRQFREMLISLVTA VDQLRNFYTHYHHSEIVIENKVLDFLNSSLVSTALHVKDKYLK TDKTKEFLKETIAAELDILIEAYKKKQIEKKNTRFKANKREDI LNAIYNEAFWSFINDKDKDKETVVAKGADAYFEKNHHKSNDPD FALNISEKGIVYLLSFFLTNKEMDSLKANLTGFKGKVDRESGN SIKYMATQRIYSFHTYRGLKQKIRTSEEGVKETLLMQMIDELS KVPNVVYQHLSTTQQNSFIEDWNEYYKDYEDDVETDDLSRVIH PVIRKRYEDRFNYFAIRFLDEFFDFPTLRFQVHLGDYVHDRRT KQLGKVESDRIIKEKVTVFARLKDINSAKANYFHSLEEQDKEE LDNKWTLFPNPSYDFPKEHTLQHQGEQKNAGKIGIYVKLRDTQ YKEKAALEEARKSLNPKERSATKASKYDIITQIIEANDNVKSE KPLVFTGQPIAYLSMNDIHSMLFSLLTDNAELKKTPEEVEAKL IDQIGKQINEILSKDTDTKILKKYKDNDLKETDTDKITRDLAR DKEEIEKLILEQKQRADDYNYTSSTKFNIDKSRKRKHLLFNAE KGKIGVWLANDIKRFMTEEFKSKWKGYQHTELQKLFAYYDTSK SDLDLILSDMVMVKDYPIELIALVKKSRTLVDFLNKYLEARLG YMENVITRVKNSIGTPQFKTVRKECFTFLKKSNYTVVSLDKQV ERILSMPLFIERGFMDDKPTMLEGKSYQQHKEKFADWFVHYKE NSNYQNFYDTEVYEITTEDKREKAKVTKKIKQQQKNDVFTLMM VNYMLEEVLKLSSNDRLSLNELYQTKEERIVNKQVAKDTQERN KNYIWNKVVDLQLCEGLVRIDKVKLKDIGNFRKYENDSRVKEF LTYQSDIVWSAYLSNEVDSNKLYVIERQLDNYESIRSKELLKE VQEIECSVYNQVANKESLKQSGNENFKQYVLQGLVPIGMDVRE MLILSTDVKFIKEEIIQLGQAGEVEQDLYSLIYIRNKFAHNQL PIKEFFDFCENNYRSISDNEYYAEYYMEIFRSIKEKYTS |
| HMPREF9711_00870 [*Myroides odoratimimus* CCUG3837] (SEQ ID No. 94) | EKB06014 | MKDILTTDTTEKQNRFYSHKIADKYFFGGYFNLASNNIYEVFE EVNKRNTFGKLAKRDNGNLKNYIIHVFKDELSISDFEKRVAIF ASYFPILETVDKKSIKERNRTIDLTLSQRIRQFREMLISLVTA VDQLRNFYTHYHHSEIVIENKVLDFLNSSLVSTALHVKDKYLK TDKTKEFLKETIAAELDILIEAYKKKQIEKKNTRFKANKREDI LNAIYNEAFWSFINDKDKDKETVVAKGADAYFEKNHHKSNDPD FALNISEKGIVYLLSFFLTNKEMDSLKANLTGFKGKVDRESGN SIKYMATQRIYSFHTYRGLKQKIRTSEEGVKETLLMQMIDELS KVPNVVYQHLSTTQQNSFIEDWNEYYKDYEDDVETDDLSRVIH PVIRKRYEDRFNYFAIRFLDEFFDFPTLRFQVHLGDYVHDRRT KQLGKVESDRIIKEKVTVFARLKDINSAKASYFHSLEEQDKEE LDNKWTLFPNPSYDFPKEHTLQHQGEQKNAGKIGIYVKLRDTQ YKEKAALEEARKSLNPKERSATKASKYDIITQIIEANDNVKSE KPLVFTGQPIAYLSMNDIHSMLFSLLTDNAELKKTPEEVEAKL IDQIGKQINEILSKDTDTKILKKYKDNDLKETDTDKITRDLAR DKEEIEKLILEQKQRADDYNYTSSTKFNIDKSRKRKHLLFNAE KGKIGVWLANDIKRFMFKESKSKWKGYQHTELQKLFAYYDTSK SDLELILSDMVMVKDYPIELIDLVRKSRTLVDFLNKYLEARLG YIENVITRVKNSIGTPQFKTVRKECFAFLKESNYTVASLDKQI ERILSMPLFIERGFMDSKPTMLEGKSYQQHKEDFADWFVHYKE |

TABLE 3-continued

| | | |
|---|---|---|
| | | NSNYQNFYDTEVYEIITEDKREQAKVTKKIKQQQKNDVFTLMM<br>VNYMLEEVLKLPSNDRLSLNELYQTKEERIVNKQVAKDTQERN<br>KNYIWNKVVDLQLCEGLVRIDKVKLKDIGNFRKYENDSRVKEF<br>LTYQSDIVWSGYLSNEVDSNKLYVIERQLDNYESIRSKELLKE<br>VQEIECIVYNQVANKESLKQSGNENFKQYVLQGLLPRGTDVRE<br>MLILSTDVKFKKEEIMQLGQVREVEQDLYSLIYIRNKFAHNQL<br>PIKEFFDFCENNYRPISDNEYYAEYYMEIFRSIKEKYAS |
| HMPREF9699_02005<br>[Bergeyella<br>zoohelcum<br>ATCC43767]<br>(SEQ ID<br>No. 95) | EKB54193 | MENKTSLGNNIYYNPFKPQDKSYFAGYFNAAMENTDSVFRELG<br>KRLKGKEYTSENFFDAIFKENISLVEYERYVKLLSDYFPMARL<br>LDKKEVPIKERKENFKKNFKGIIKAVRDLRNFYTHKEHGEVEI<br>TDEIFGVLDEMLKSTVLTVKKKKVKTDKTKEILKKSIEKQLDI<br>LCQKKLEYLRDTARKIEEKRRNQRERGEKELVAPFKYSDKRDD<br>LIAAIYNDAFDVYIDKKKDSLKESSKAKYNTKSDPQQEEGDLK<br>IPISKNGVVFLLSLELTKQEIHAFKSKIAGFKATVIDEATVSE<br>ATVSHGKNSICEMATHEIFSHLAYKKLKRKVRTAEINYGEAEN<br>AEQLSVYAKETLMMQMLDELSKVPDVVYQNLSEDVQKTFIEDW<br>NEYLKENNGDVGTMEEEQVIHPVIRKRYEDKENYFAIRELDEF<br>AQFPPTLRFQVHLGNYLHDSRPKENLISDRRIKEKITVFGRLSE<br>LEHKKALFIKNTETNEDREHYWEIFPNPNYDEPKENISVNDKD<br>EPIAGSILDREKQPVAGKIGIKVLLNQQYVSEVDKAVKAHQL<br>KQRKASKPSIQNIIEEIVPINESNPKEAIVEGGQPTAYLSMND<br>IHSILYEEEDKWEKKKEKLEKKGEKELRKEIGKELEKKIVGKI<br>QAQIQQIIDKDTNAKILKPYQDGNSTAIDKEKLIKDLKQEQNI<br>LQKLKDEQTVREKEYNDEIAYQDKNREINKVRDRNHKQYLKDN<br>LKRKYPEAPARKEVLYYREKGKVAVWLANDIKRFMPTDFKNEW<br>KGEQHSLLQKSLAYYEQCKEELKNLLPEKVFQHLPFKLGGYFQ<br>QKYLYQFYTCYLDKRLEYISGLVQQAENEKSENKVEKKVENEC<br>EKELKKQNYTHKELDARVQSILGYPIELERGEMDEKPTIIKGK<br>TEKGNEALEADWERYYKEYQNFQTFYDTENYPLVELEKKQADR<br>KRKTKIYQQKKNDVFTLLMAKHIFKSVFKQDSIDQFSLEDLYQ<br>SREERLGNQERARQTGERNTNYIWNKTVDLKLCDGKITVENVK<br>LKNVGDFIKYEYDQRVQAELKYEENIEWQAELIKESKEEENYP<br>YVVEREIEQYEKVRREELLKEVHLIEEYILEKVKDKEILKKGD<br>NQNFKYYILNGLLKQLKNEDVESYKVENLNTEPEDVNINQLKQ<br>EATDLEQKAFVLTYIRNKFAHNQLPKKEEWDYCQEKYGKIEKE<br>KTYAEYEAEVEKKEKEALIK |
| HMPREF9151_01387<br>[Prevotella<br>saccharolytica<br>F0055]<br>(SEQ ID<br>No. 96) | EKY00089 | MMEKENVQGSHIYYEPTDKCEWAAFYNLARHNAYLTIAHINSF<br>VNSKKGINNDDKVLDIIDDWSKEDNDLLMGARLNKLILKHFPF<br>LKAPLYQLAKRKTRKQQGKEQQDYEKKGDEDPEVIQEAIANAF<br>KMANVRKTLHAFLKQLEDLRNHFSHYNYNSPAKKMEVKFDDGE<br>CNKLYYVFDAALQMVKDDNRMNPEINMQTDFEHLVRLGRNRKI<br>PNTEKYNETNSDGTINNNGLLEFVSLFLEKRDAIWMQKKIKGF<br>KGGTENYMRMTNEVFCRNRMVIPKLRLETDYDNHQLMFDMLNE<br>LVRCPLSLYKRLKQEDQDKERVPIEELDEDNEADNPYQENANS<br>DENPTEETDPLKNTLVRHQHREPYFVLRYEDLNEVEKQLREQI<br>NLGCYHFSIYDKTIGERTEKRHLTRTLFGFDRLQNFSVKLQPE<br>HWKNMVKHLDTEESSDKPYLSDAMPHYQIENEKIGIHFLKTDT<br>EKKETVWPSLEVEEVSSNRNKYKSEKNLTADAFLSTHELLPMM<br>FYYQLLSSEEKTRAAAGDKVQGVLQSYRKKIFDIYDDFANGTI<br>NSMQKLDERLAKDNLLRGNMPQQMLAILEHQEPDMEQKAKEKL<br>DRLITETKKRIGKLEDQFKQKVRIGKRRADLPKVGSIADWLVN<br>DMMRFQPAKRNADNTGVPDSKANSTEYRLLQEALAFYSAYKDR<br>LEPYFRQVNLIGGTNPHPFLHRVDWKKCNHLLSFYHDYLEAKE<br>QYLSHLSPADWQKHQHFLLLKVRKDIQNEKKDWKKSLVAGWKN<br>GFNLPRGLFTESIKTWFSTDADKVQITDTKLFENRVGLIAKLI<br>PLYYDKVYNDKPQPFYQYPFNINDRYKPEDTRKRFTAASSKLW<br>NEKKMLYKNAQPDSSDKIEYPQYLDFLSWKKLERELRMLRNQD<br>MMVWLMCKDLFAQCTVEGVEFADLKLSQLEVDVNVQDNLNVLN<br>NVSSMILPLSVYPSDAQGNVLRNSKPLHTVYVQENNTKLLKQG<br>NFKSLLKDRRLNGLFSFIAAEGEDLQQHPLTKNRLEYELSIYQ<br>TMRISVFEQTLQLEKAILTRNKTLCGNNFNNLLNSWSEHRTDK<br>KTLQPDIDPLIAVRNAFSHNQYPMSTNTVMQGIEKFNIQTPKL<br>EEKDGLGIASQLAKKTKDAASRLQNIINGGTN |
| A343_1752<br>[Porphyromonas<br>gingivalis<br>JCVISC001]<br>(SEQ ID<br>No. 97) | EOA10535 | MTEQNEKPYNGTYYTLEDKHFWAAFFNLARHNAYITLTHIDRQ<br>LAYSKADITNDEDILFFKGQWKNLDNDLERKARLRSLILKHFS<br>FLEGAAYGKKLFESQSSGNKSSKKKELTKKEKEELQANALSLD<br>NLKSILFDFLQKLKDFRNYYSHYRHPESSELPLFDGNMLQRLY<br>NVFDVSVQRVKRDHEHNDKVDPHRHFNHLVRKGKKDRCGNNDN<br>PFFKHHFVDREEKVTEAGLLFFVSLFLEKRDAIWMQKKIRGFK<br>GGTETYQQMTNEVFCRSRISLPKLKLESLRTDDWMLLDMLNEL<br>VRCPKSLYDRLREEDRARFRVPVDILSDEDDTGTEEDPFKNT<br>LVRHQDRFPYFALRYFDLKKVFTSLRFHIDLGTYHFAIYKKNI<br>GEQPEDRHLTRNLYGFGRIQDFAEEHRPEEWKRLVRDLDYFET<br>GDKPYITQTTPHYHIEKGKIGLRFVPEGQLLWPSPEVGATRTG<br>RSKYAQDKRFTAEAFLSVHELMPMMFYFLLREKYSEEASAER<br>VQGRIKRVIEDVYAVYDAFARGEIDTLDRLDACLADKGIRRGH<br>LPRQMIAILSQEHKDMEEKVRKKLQEMIADTDHRLDMLDRQTD |

TABLE 3-continued

| | | |
|---|---|---|
| | | RKIRIGRKNAGLPKSGVIADWLVRDMMRFQPVAKDTSGKPLNN<br>SKANSTEYRMLQRALALFGGEKERLTPYFRQMNLTGGNNPHPF<br>LHETRWESHTNILSFYRSYLKARKAFLQSIGRSDRVENHRFLL<br>LKEPKTDRQTLVAGWKGEFHLPRGIFTEAVRDCLIEMGLDEVG<br>SYKEVGFMAKAVPLYFERACKDRVQPFYDYPFNVGNSLKPKKG<br>RFLSKEKRAEEWESGKERFRDLEAWSHSAARRIEDAFAGIENA<br>SRENKKKIEQLLQDLSLWETFESKLKVKADKINIAKLKKEILE<br>AKEHPYLDFKSWQKFERELRLVKNQDIITWMMCRDLMEENKVE<br>GLDTGTLYLKDIRTDVHEQGSLNVLNRVKPMRLPVVVYRADSR<br>GHVHKEQAPLATVYIEERDTKLLKQGNFKSFVKDRRLNGLFSF<br>VDTGALAMEQYPISKLRVEYELAKYQTARVCAFEQTLELEESL<br>LTRYPHLPDKNFRKMLESWSDPLLDKWPDLHGNVRLLIAVRNA<br>FSHNQYPMYDETLFSSIRKYDPSSPDAIEERMGLNIAHRLSEE<br>VKQAKEMVERIIQA |
| HMPREF1981_03090<br>[*Bacteroides pyogenes* F0041]<br>(SEQ ID<br>No. 98) | ERI81700 | MESIKNSQKSTGKTLQKDPPYFGLYLNMALLNVRKVENHIRKW<br>LGDVALLPEKSGFHSLLTTDNLSSAKWTRFYYKSRKFLPFLEM<br>FDSDKKSYENRRETTECLDTIDRQKISSLLKEVYGKLQDIRNA<br>FSHYHIDDQSVKHTALITSSEMHRFIENAYSFALQKTRARFTG<br>VFVETDFLQAEEKGDNKKFFAIGGNEGIKLKDNALIFLICLFL<br>DREEAFKFLSRATGFKSTKEKGFLAVRETFCALCCRQPHERLL<br>SVNPREALLMDMLNELNRCPDILFEMLDEKDQKSFLPLLGEEE<br>QAHILENSLNDELCEAIDDPFEMIASLSKRVRYKNRFPYLMLR<br>YIEEKNLLPFIRFRIDLGCLELASYPKKMGEENNYERSVTDHA<br>MAFGRLTDFHNEDAVLQQITKGITDEVRFSLYAPRYAIYNNKI<br>GFVRTGGSDKISFPTLKKKGGEGHCVAYTLQNTKSFGEISIYD<br>LRKILLLSFLDKDKAKNIVSGLLEQCEKHWKDLSENLFDAIRT<br>ELQKEFPVPLIRYTLPRSKGGKLVSSKLADKQEKYESEFERRK<br>EKLTEILSEKDFDLSQIPRRMIDEWLNVLPTSREKKLKGYVET<br>LKLDCRERLRVFEKREKGEHPVPPRIGEMATDLAKDIIRMVID<br>QGVKQRITSAYYSEIQRCLAQYAGDDNRRHLDSIIRELRLKDT<br>KNGHPFLGKVLRPGLGHTEKLYQRYFEEKKEWLEATFYPAASP<br>KRVPRFVNPPTGKQKELPLIIRNLMKERPEWRDWKQRKNSHPI<br>DLPSQLFENEICRLLKDKIGKEPSGKLKWNEMFKLYWDKEFPN<br>GMQRFYRCKRRVEVEDKVVEYEYSEEGGNYKKYYEALIDEVVR<br>QKISSSKEKSKLQVEDLTLSVRRVFKRAINEKEYQLRLLCEDD<br>RLLFMAVRDLYDWKEAQLDLDKIDNMLGEPVSVSQVIQLEGGQ<br>PDAVIKAECLKLDVSKLMRYCYDGRVKGLMPYFANHEATQEQV<br>EMELRHYEDHRRRVFNWVFALEKSVLKNEKLRRFYEESQGGCE<br>HRRCIDALRKASLVSEEEYEFLVHIRNKSAHNQFPDLEIGKLP<br>PNVTSGFCECIWSKYKAIICRIIPFIDPERRFFGKLLEQK |
| HMPREF1553_02065<br>[*Porphyromonas gingivalis* F0568]<br>(SEQ ID<br>No. 99) | ERJ65637 | MNTVPASENKGQSRTVEDDPQYFGLYLNLARENLIEVESHVRI<br>KFGKKKLNEESLKQSLLCDHLLSVDRWTKVYGHSRRYLPFLHY<br>FDPDSQIEKDHDSKTGVDPDSAQRLIRELYSLLDFLRNDFSHN<br>RLDGTTFEHLEVSPDISSFITGTYSLACGRAQSRFADFFKPDD<br>FVLAKNRKEQLISVADGKECLTVSGLAFFICLFLDREQASGML<br>SRIRGFKRTDENWARAVHETFCDLCIRHPHDRLESSNTKEALL<br>LDMLNELNRCPRILYDMLPEEERAQFLPALDENSMNNLSENSL<br>NEESRLLWDGSSDWAEALTKRIRHQDRFPYLMLRFIEEMDLLK<br>GIRFRVDLGEIELDSYSKKVGRNGEYDRTITDHALAFGKLSDF<br>QNEEEVSRMISGEASYPVRFSLFAPRYAIYDNKIGYCHTSDPV<br>YPKSKTGEKRALSNPRSMGFISVHDLRKLLLMELLCEGSFSRM<br>QSDFLRKANRILDETAEGKLQFSALFPEMRHRFIPPQQNPKSKD<br>RREKAETTLEKYKQEIKGRKDKLNSQLLSAFDMDQRQLPSRLL<br>DEWMNIRPASHSVKLRTYVKQLNEDCRLRLQKFRKDGDGKARA<br>IPLVGEMATFLSQDIVIMIISEETKKLITSAYYNEMQRSLAQY<br>AGEENRHQFRAIVAELRLLDPSSGHPFLSATMETAHRYTEDFY<br>KCYLEKKREWLAKTFYRPEQDENTKRRISVFFVPDGEARKLLP<br>LLIRRRMKEQNDLQDWIRNKQAHPIDLPSHLFDSKIMELLVKVK<br>DGKKKWNEAFKDWWSTKYPDGMQPFYGLRRELNIHGKSVSYIP<br>SDGKKFADCYTHLMEKTVQDKKRELRTAGKPVPPDLAADIKRS<br>FHRAVNEREFMLRLVQEDDRLMLMAINKMMTDREEDILPGLKN<br>IDSILDEENQFSLAVHAKVLEKEGEGGDNSLSLVPATIEIKSK<br>RKDWSKYIRYRYDRRVPGLMSHPPEHKATLDEVKTLLGEYDRC<br>RIKIFDWAFALEGAIMSDRDLKPYLHESSSREGKSGEHSTLVK<br>MLVEKKGCLTPDESQYLILIRNKAAHNQFPCAAEMPLIYRDVS<br>AKVGSIEGSSAKDLPEGSSLVDSLWKKYEMIIRKILPILDPEN<br>RFFGKLLNNMSQPINDL |
| HMPREF1988_01768<br>[*Porphyromonas gingivalis* F0185]<br>(SEQ ID<br>No. 100) | ERJ81987 | MNTVPASENKGQSRTVEDDPQYFGLYLNLARENLIEVESHVRI<br>KFGKKKLNEESLKQSLLCDHLLSVDRWTKVYGHSRRYLPFLHY<br>FDPDSQIEKDHDSKTGVDPDSAQRLIRELYSLLDFLRNDFSHN<br>RLDGTTFEHLEVSPDISSFITGTYSLACGRAQSRFADFFKPDD<br>FVLAKNRKEQLISVADGKECLTVSGLAFFICLFLDREQASGML<br>SRIRGFKRTDENWARAVHETFCDLCIRHPHDRLESSNTKEALL<br>LDMLNELNRCPRILYDMLPEEERAQFLPALDENSMNNLSENSL<br>NEESRLLWDGSSDWAEALTKRIRHQDRFPYLMLRFIEEMDLLK<br>GIRFRVDLGEIELDSYSKKVGRNGEYDRTITDHALAFGKLSDF<br>QNEEEVSRMISGEASYPVRFSLFAPRYAIYDNKIGYCHTSDPV |

TABLE 3-continued

| | | |
|---|---|---|
| | | YPKSKTGEKRALSNPQSMGFISVHDLRKLLLMELLCEGSFSRM<br>QSGFLRKANRILDETAEGKLQFSALFPEMRHRFIPPQNPKSKD<br>RREKAETTLEKYKQEIKGRKDKLNSQLLSAFDMNQRQLPSRLL<br>DEWMNIRPASHSVKLRTYVKQLNEDCRLRLRKFRKDGDGKARA<br>IPLVGEMATFLSQDIVRMIISEETKKLITSAYYNEMQRSLAQY<br>AGEENRRQFRAIVAELHLLDPSSGHPFLSATMETAHRYTEDFY<br>KCYLEKKREWLAKTFYRPEQDENTKRRISVFFVPDGEARKLLP<br>LLIRRRMKEQNDLQDWIRNKQAHPIDLPSHLFDSKIMELLKVK<br>DGKKKWNEAFKDWWSTKYPDGMQPFYGLRRELNIHGKSVSYIP<br>SDGKKFADCYTHLMEKTVQDKKRELRTAGKPVPPDLAADIKRS<br>FHRAVNEREFMLRLVQEDDRLMLMAINKMMTDREEDILPGLKN<br>IDSILDEENQFSLAVHAKVLEKEGEGGDNSLSLVPATIEIKSK<br>RKDWSKYIRYRYDRRVPGLMSHFPEHKATLDEVKTLLGEYDRC<br>RIKIFDWAFALEGAIMSDRDLKPYLHESSSREGKSGEHSTLVK<br>MLVEKKGCLTPDESQYLILIRNKAAHNQFPCAEMPLIYRDVS<br>AKVGSIEGSSAKDLPEGSSLVDSLWKKYEMIIRKILPILDHEN<br>RFFGKLLNNMSQPINDL |
| HMPREF1990_01800<br>[*Porphyromonas<br>gingivalis*<br>W4087]<br>(SEQ ID<br>No. 101) | ERJ87335 | MNTVPASENKGQSRTVEDDPQYFGLYLNLARENLIEVESHVRI<br>KFGKKKLNEESLKQSLLCDHLLSVDRWTKVYGHSRRYLPFLHY<br>FDPDSQIEKDHDSKTGVDPDSAQRLIRELYSLLDFLRNDFSHN<br>RLDGTTFEHLEVSPDISSFITGTYSLACGRAQSRFADFFKPDD<br>FVLAKNRKEQLISVADGKECLTVSGLAFFICLFLDREQASGML<br>SRIRGFKRTDENWARAVHETFCDLCIRHPHDRLESSNTKEALL<br>LDMLNELNRCPRILYDMLPEEERAQFLPALDENSMNNLSENSL<br>NEESRLLWDGSSDWAEALTKRIRHQDRFPYLMLRFIEEMDLLK<br>GIRPFRVDLGEIELDSYSKKVGRNGEYDRTITDHALAFGKLSDF<br>QNEEEVSRMISGEASYPVRFSLFAPRYAIYDNKIGYCHTSDPV<br>YPKSKTGEKRALSNPRSMGFISVHDLRKLLLMELLCEGSFSRM<br>QSDFLRKANRILDETAEGKLQFSALFPEMRHRFIPPQNPKSKD<br>RREKAETTLEKYKQEIKGRKDKLNSQLLSAFDMDQRQLPSRLL<br>DEWMNIRPASHSVKLRTYVKQLNEDCRLRLQKFRKDGDGKARA<br>IPLVGEMATFLSQDIVRMIISEETKKLITSAYYNEMQRSLAQY<br>AGEENRHQFRAIVAELRLLDPSSGHPFLSATMETAHRYTEDFY<br>KCYLEKKREWLAKTFYRPEQDENTKRRISVFFVPDGEARKLLP<br>LLIRRRMKEQNDLQDWIRNKQAHPIDLPSHLFDSKVMELLKVK<br>DGKKKWNEAFKDWWSTKYPDGMQPFYGLRRELNIHGKSVSYIP<br>SDGKKFADCYTHLMEKTVRDKKRELRTAGKPVPPDLAAYIKRS<br>FHRAVNEREFMLRLVQEDDRLMLMAINKIMTDREEDILPGLKN<br>IDSILDKENQFSLAVHAKVLEKEGEGGDNSLSLVPATIEIKSK<br>RKDWSKYIRYRYDRRVPGLMSHFPEHKATLDEVKTLLGEYDRC<br>RIKIFDWAFALEGAIMSDRDLKPYLHESSSREGKSGEHSTLVK<br>MLVEKKGCLTPDESQYLILIRNKAAHNQFPCAAEIPLIYRDVS<br>AKVGSIEGSSAKDLPEGSSLVDSLWKKYEMIIRKILPILDPEN<br>RFFGKLLNNMSQPINDL |
| M573_117042<br>[*Prevotella<br>intermedia*<br>ZT] (SEQ<br>ID No.<br>102) | KJJ86756 | MKMEDDKKTTESTNMLDNKHFWAAFLNLARHNVYITVNHINKV<br>LELKNKKDQDIIIDNDQDILAIKTHWEKVNGDLNKTERLRELM<br>TKHFPFLETAIYTKNKEDKEEVKQEKQAEAQSLESLKDCLFLF<br>LEKLQEARNYYSHYKYSESTKEPMLEEGLLEKMYNIFDDNIQL<br>VIKDYQHNKDINPDEDFKHLDRKGQFKYSFADNEGNITESGLL<br>FFVSLFLEKKDAIWMQQKLTGFKDNRESKKKMTHEVFCRRRML<br>LPKLRLESTQTQDWILLDMLNELIRCPKSLYERLQGEYRKKFN<br>VPFDSADEDYDAEQEPFKNTLVRHQDRFPYFALRYFDYNEIFT<br>NLRFQIDLGTYHFSIYKKLIGGQKEDRHLTHKLYGFERIQEFA<br>KQNRPDEWKALVKDLDTYETSNERYISETTPHYHLENQKIGIR<br>FRNGNKEIWPSLKTNGENNEKSKYKLDKPYQAEAFLSVHELLP<br>MMFYYLLLKKEEPNNDKKNASIVEGFIKREIRDMYKLYDAFAN<br>GEINNIGDLEKYCEDKGIPKRHLPKQMVAILYDEPKDMVKEAK<br>RKQKEMVKDTKKLLATLEKQTQEEIEDGGRNIRLLKSGEIARW<br>LVNDMMRFQPVQKDNEGNPLNNSKANSTEYQMLQRSLALYNKE<br>EKPTRYFRQVNLINSSNPHPFLKWTKWEECNNILSFYRNYLTK<br>KIEFLNKLKPEDWEKNQYFLKLKEPKTNRETLVQGWKNGFNLP<br>RGIFTEPIREWFKRHQNDSKEYEKVEALKRVGLVTKVIPLEFK<br>EEYEKEDAQKEINNCVQPFYSFPPYNVGNIHKPDEKDFLPSEER<br>KKLWGDKKDKFKGYKAKVKSKKLTDKEKEEYRSYLEFQSWNKF<br>ERELRLVRNQDIVTWLLCTELIDKMKVEGLNVEELQKLRLKDI<br>DTDTAKQEKNNILNRIMPMQLPVTVYEIDDSHNIVKDRPLHTV<br>YIEETKTKLLKQGNFKALVKDRRLNGLFSFVDTSSKAELKDKP<br>ISKSVVEYELGEYQNARIETIKDMLLLEKTLIKKYEKLPTDNF<br>SDMLNGWLEGKDESDKARFQNDVKLLVAVRNAFSHNQYPMRNR<br>IAFANINPFSLSSADISEEKKLDIANQLKDKTHKIIKKIIEIE<br>KPIETKE |
| A2033_10205<br>[*Bacteroidetes<br>bacterium*<br>GWA2_319]<br>(SEQ ID<br>No. 103) | OFX18020.1 | MENQTQKGKGIYYYYTKNEDKHYFGSFLNLANNNIEQIIEEFR<br>IRLSLKDEKNIKEIINNYFTDKKSYTDWERGINILKEYLPVID<br>YLDLAITDKEFEKIDLKQKETAKRKYFRTNFSLLIDTIIDLRN<br>FYTHYFHKPISINPDVAKFLDKNLLNVCLDIKKQKMKTDKTKQ<br>ALKDGLDKELKKLIELKKAELKEKKIKTWNITENVEGAVYNDA<br>FNHMVYKNNAGVTILKDYHKSILPDDKIDSELKLNFSISGLVF |

TABLE 3-continued

| | | |
|---|---|---|
| | | LLSMFLSKKEIEQFKSNLEGFKGKVIGENGEYEISKFNNSLKY<br>MATHWIFSYLTFKGLKQRVKNTEDKETLLMQMIDELNKVPHEV<br>YQTLSKEQQNEFLEDINEYVQDNEENKKSMENSIVVHPVIRKR<br>YDDKENYFAIRELDEFANEPTLKFFVTAGNEVHDKREKQIQGS<br>MLTSDRMIKEKINVFGKLTEIAKYKSDYFSNENTLETSEWELF<br>PNPSYLLIQNNIPVHIDLIHNTEEAKQCQIAIDRIKCTTNPAK<br>KRNTRKSKEEIIKIIYQKNKNIKYGDPTALLSSNELPALIYEL<br>LVNKKSGKELENIIVEKIVNQYKTIAGFEKGQNLSNSLITKKL<br>KKSEPNEDKINAEKIILAINRELEITENKLNIIKNNRAEFRTG<br>AKRRKHIFYSKELGQEATWIAYDLKREMPEASRKEWKGEHHSEL<br>QKFLAFYDRNKNDAKALLNMEWNEDNDQLIGNDLNSAFREFHF<br>DKEYEKYLIKRDEILEGFKSFISNFKDEPKLLKKGIKDIYRVE<br>DKRYYIIKSTNAQKEQLLSKPICLPRGIFDNKPTYIEGVKVES<br>NSALFADWYQYTYSDKHEFQSFYDMPRDYKEQFEKFELNNIKS<br>IQNKKNLNKSDKFIYFRYKQDLKIKQIKSQDLFIKLMVDELEN<br>VVEKNNIELNLKKLYQTSDERFKNQLIADVQKNREKGDTSDNK<br>MNENFIWNMTIPLSLCNGQIEEPKVKLKDIGKFRKLETDDKVI<br>QLLEYDKSKVWKKLEIEDELENMPNSYERIRREKLLKGIQEFE<br>HFLLEKEKFDGINHPKHFEQDLNPNFKTYVINGVLRKNSKLNY<br>TEIDKLLDLEHISIKDIETSAKEIHLAYFLIHVRNKFGHNQLP<br>KLEAFELMKKYYKKNNEETYAEYFHKVSSQIVNEFKNSLEKHS |
| SAMN05421542_0666<br>[*Chryseobacterium<br>jejuense*]<br>(SEQ ID<br>No. 104) | SDI27289.1 | MEKTQTGLGIYYDHTKLQDKYFFGGFFNLAQNNIDNVIKAFII<br>KFFPERKDKDINIAQFLDICFKDNDADSDFQKKNKFLRIHFPV<br>IGFLTSDNDKAGFKKKFALLLKTISELRNFYTHYYHKSIEFPS<br>ELFELLDDIFVKTTSEIKKLKKKDDKTQQLLNKNLSEEYDIRY<br>QQQIERLKELKAQGKRVSLTDETAIRNGVFNAAFNHLIYRDGE<br>NVKPSRLYQSSYSEPDPAENGISLSQNSILFLLSMFLERKETE<br>DLKSRVKGFKAKIIKQGEEQISGLKFMATHWVFSYLCFKGIKQ<br>KLSTEFHEETLLIQIIDELSKVPDEVYSAFDSKTKEKFLEDIN<br>EYMKEGNADLSLEDSKVIHPVIRKRYENKFNYFAIRFLDEYLS<br>STSLKFQVHVGNYVHDRRVKHINGTGFQTERIVKDRIKVFGRL<br>SNISNLKADYIKEQLELPNDSNGWEIFPNPSYIFIDNNVPIHV<br>LADEATKKGIELFKDKRREQPEELQRKGKISKYNIVSMIYK<br>EAKGKDKLRIDEPLALLSLNEIPALLYQILEKGATPKDIELII<br>KNKLTERFEKIKNYDPETPAPASQISKRLRNNTTAKGQEALNA<br>EKLSLLIEREIENTETKLSSIEEKRLKAKKEQRRNTPQRSIFS<br>NSDLGRIAAWLADDIKRFMPAEQRKNWKGYQHSQLQQSLAYFE<br>KRPQEAFLLLKEGWDTSDGSSYWNNWVMNSFLENNHFEKFYKN<br>YLMKRVKYFSELAGNIKQHTHNTKFLRKFIKQQMPADLFPKRH<br>YILKDLETEKNKVLSKPLVFSRGLFDNNPTFIKGVKVTENPEL<br>FAEWYSYGYKTEHVFQHFYGWERDYNELLDSELQKGNSFAKNS<br>IYYNRESQLDLIKLKQDLKIKKIKIQDLFLKRIAEKLFENVFN<br>YPTTLSLDEFYLTQEERAEKERIALAQSLREEGDNSPNIIKDD<br>FIWSKTIAFRSKQIYEPAIKLKDIGKFNRFVLDDEESKASKLL<br>SYDKNKIWNKEQLERELSIGENSYEVIRREKLFKEIQNLELQI<br>LSNWSWDGINHPREFEMEDQKNTRHPNFKMYLVNGILRKNINL<br>YKEDEDFWLESLKENDFKTLPSEVLETKSEMVQLLFLVILIRN<br>QFAHNQLPEIQFYNFIRKNYPEIQNNTVAELYLNLIKLAVQKL<br>KDNS |
| SAMN05444360_11366<br>[*Chryseobacterium<br>carnipullorum*]<br>(SEQ ID<br>No. 105) | SHM52812.1 | MNTRVTGMGVSYDHTKKEDKHFFGGFLNLAQDNITAVIKAFCI<br>KFDKNPMSSVQFAESCFTDKDSDTDFQNKVRYVRTHLPVIGYL<br>NYGGDRNTFRQKLSTLLKAVDSLRNFYTHYYHSPLALSTELFE<br>LLDTVFASVAVEVKQHKMKDDKTRQLLSKSLAEELDIRYKQQL<br>ERLKELKEQGKNIDLRDEAGIRNGVLNAAFNHLIYKEGEIAKP<br>TLSYSSFYYGADSAENGITISQSGLLFLLSMFLGKKEIEDLKS<br>RIRGFKAKIVRDGEENISGLKFMATHWIFSYLSFKGMKQRLST<br>DFHEETLLIQIIDELSKVPDEVYHDFDTATREKFVEDINEYIR<br>EGNEDFSLGDSTIIHPVIRKRYENKFNYFAVRFLDEFIKFPSL<br>RFQVHLGNFVHDRRIKDIHGTGFQTERVVKDRIKVFGKLSEIS<br>SLKTEYIEKELDLSDTGWEIFPNPSYVFIDNNIPIYISTNKT<br>FKNGSSEFIKLRRKEKPEEMKMRGEDKKEKRDIASMIGNAGSL<br>NSKTPLAMLSLNEMPALLYEILVKKTTPEEIELIIKEKLDSHF<br>ENIKNYDPEKPLPASQISKRLRNNTTDKGKKVINPEKLIHLIN<br>KEIDATEAKFALLAKNRKELKEKFRGKPLRQTIFSNMELGREA<br>TWLADDIKRFMPDILRKNWKGYQHNQLQQSLAFFNSRPKEAFT<br>ILQDGWDFADGSSFWNGWIINSFVKNRSFEYFYEAYFEGRKEY<br>FSSLAENIKQHTSNHRNLRRFIDQQMPKGLFENRHYLLENLET<br>EKNKILSKPLVFPRGLFDTKPTFIKGIKVDEQPELFAEWYQYG<br>YSTEHVFQNFYGWERDYNDLLESELEKDNDFSKNSIHYSRTSQ<br>LELIKLKQDLKIKKIKIQDLFLKLIAGHIFENIFKYPASFSLD<br>ELYLTQEERLNKEQEALIQSQRKEGDHSDNIIKDNFIGSKTVT<br>YESKQISEPNVKLKDIGKFNRFLLDDKVKTLLSYNEDKVWNKN<br>DLDLELSIGENSYEVIRREKLFKKIQNFELQTLTDWPWNGTDH<br>PEEFGTTDNKGVNHPNFKMYVVNGILRKHTDWFKEGEDNWLEN<br>LNETHFKNLSFQELETKSKSIQTAFLIIMIRNQFAHNQLPAVQ<br>FFEFIQKKYPEIQGSTTSELYLNFINLAVVELLELLEK |

TABLE 3-continued

| | | |
|---|---|---|
| SAMN05421786_1011119 [*Chryseobacterium ureilyticum*] (SEQ ID No. 106) | SIS70481.1 | METQILGNGISYDHTKTEDKHFFGGFLNTAQNNIDLLIKAYIS KFESSPRKLNSVQFPDVCFKKNDSDADFQHKLQFIRKHLPVIQ YLKYGGNREVLKEKFRLLLQAVDSLRNFYTHFYHKPIQLPNEL LTLLDTIFGEIGNEVRQNKMKDDKTRHLLKKNLSEELDFRYQE QLERLRKLKSEGKKVDLRDTEAIRNGVLNAAFNHLIFKDAEDF KPTVSYSSYYYDSDTAENGISISQSGLLFLLSMFLGRREMEDL KSRVRGFKARIIKHEEQHVSGLKFMATHWVFSEFCFKGIKTRL NADYHEETLLIQLIDELSKVPDELYRSFDVATRERFIEDINEY IRDGKEDKSLIESKIVHPVIRKRYESKFNYFAIRFLDEFVNFP TLRFQVHAGNYVHDRRIKSIEGTGFKTERLVKDRIKVFGKLST ISSLKAEYLAKAVNITDDTGWELLPHPSYVFIDNNIPIHLTVD PSFKNGVKEYQEKRKLQKPEEMKNRQGGDKMHKPAISSKIGKS KDINPESPVALLSMNEIPALLYEILVKKASPEEVEAKIRQKLT AVFERIRDYDPKVPLPASQVSKRLRNNTDTLSYNKEKLVELAN KEVEQTERKLALITKNRRECEREKVKGKFKRQKVFKNAELGTEA TWLANDIKRFMPEEQKKNWKGYQHSQLQQSLAFFESRPGEARS LLQAGWDFSDGSSFWNGWVMNSFARDNTFDGFYESYLNGRMKY FLRLADNIAQQSSTNKLISNFIKQQMPKGLFDRRLYMLEDLAT EKNKILSKPLIFPRGIFDDKPTFKKGVQVSEEPEAFADWYSYG YDVKHKFQEFYAWDRDYEELLREELEKDTAFTKNSIHYSRESQ IELLAKKQDLKVKKVRIQDLYLKLMAEFLFENVFGHELALPLD QFYLTQEERLKQEQEAIVQSQRPKGDDSPNIVKENFIWSKTIP FKSGRVFEPNVKLKDIGKFRNLLTDEKVDILLSYNNTEIGKQV IENELIIGAGSYEFIRREQLFKEIQQMKRLSLRSVRGMGVPIR LNLK |
| *Prevotella buccae* (SEQ ID No. 107) | WP_004343581 | MQKQDKLFVDRKKNAIFAFPKYITIMENQEKPEPIYYELTDKH FWAAFLNLARHNVYTTINHINRRLEIAELKDDGYMMDIKGSWN EQAKKLDKKVRLRDLIMKHFPFLEAAAYEITNSKSPNNKEQRE KEQSEALSLNNLKNVLFIFLEKLQVLRNYYSHYKYSEESPKPI FETSLLKNMYKVFDANVRLVKRDYMHHENIDMQRDFTHLNRKK QVGRTKNIIDSPNFHYHFADKEGNMTIAGLLFFVSLFLDKKDA IWMQKKLKGFKDGRNLREQMTNEVFCRSRISLPKLKLENVQTK DWMQLDMLNELVRCPKSLYERLREKDRESFKVPFDIFSDDYDA EEEPFKNTLVRHQDRFPYFVLRYFDLNEIFEQLRFQIDLGTYH FSIYNKRIGDEDEVRHLTHHLYGFARIQDFAQQNQPEVWRKLV KDLDYFEASQEPYIPKTAPHYHLENEKIGIKFCSTHNNLFPSL KTEKTCNGRSKFNLGTQFTAEAFLSVHELLPMMFYYLLLTKDY SRKESADKVEGIIRKEISNIYAIYDAFANGEINSIADLTCRLQ KTNILQGHLPKQMISILEGRQKDMEKEAERKIGEMIDDTQRRL DLLCKQTNQKIRIGKRNAGLLKSGKIADWLVNDMMRFQPVQKD QNNIPINNSKANSTEYRMLQRALALFGSENFRLKAYFNQMNLV GNDNPHPPLAETQWEHQTNILSFYRNYLEARKKYLKGLKPQNW KQYQHFLILKVQKTNRNTLVTGWKNSFNLPRGIFTQPIREWFE KHNNSKRIYDQILSFDRVGFVAKAIPLYFAEEYKDNVQPFYDY PFNIGNKLKPQKGQFLDKKERVELWQKNKELFKNYPSEKKKTD LAYLDFLSWKKFERELRLIKNQDIVTWLMFKELFNMATVEGLK IGEIHLRDIDTNTANEESNNILNRIMPMKLPVKTYETDNKGNI LKERPLATFYIEETETKVLKQGNFKVLAKDRRLNGLLSFAETT DIDLEKNPITKLSVDHELIKYQTTRISIFEMTLGLEKKLINKY PTLPTDSFRNMLERWLQCKANRPELKNYVNSLIAVRNAFSHNQ YPMYDATLFAEVKKFTLFPSVDTKKIELNIAPQLLEIVGKAIK EIEKSENKN |
| *Porphyromonas gingivalis* (SEQ ID No. 108) | WP_005873511 | MNTVPASENKGQSRTVEDDPQYFGLYLNLARENLIEVESHVRI KFGKKKLNEESLKQSLLCDHLLSVDRWTKVYGHSRRYLPFLHY FDPDSQIEKDHDSKTGVDPDSAQRLIRELYSLLDFLRNDFSHN RLDGTTFEHLEVSPDISSFITGTYSLACGRAQSRFADFFKPDD FVLAKNRKEQLISVADGKECLTVSGLAFFICLFLDREQASGML SRIRGFKRTDENWARAVHETFCDLCIRHPHDRLESSNTKEALL LDMLNELNRCPRILYDMLPEEERAQFLPALDENSMNNLSENSL NEESRLLWDGSSDWAEALTKRIRHQDRFPYLMLRFIEEMDLLK GIRFRVDLGEIELDSYSKKVGRNGEYDRTITDHALAFGKLSDF QNEEEVSRMISGEASYPVRFSLFAPRYAIYDNKIGYCHTSDPV YPKSKTGEKRALSNPQSMGFISVHNLRKLLLMELLCEGSFSRM QSDFLRKANRILDETAEGKLQFSALFPEMRHRFIPPQNPKSKD RREKAETTLEKYKQEIKGRKDKLNSQLLSAFDMNQRQLPSRLL DEWMNIRPASHSVKLRTYVKQLNEDCRLRLRKFRKDGDGKARA IPLVGEMATFLSQDIVRMIISEETKKLITSAYYNEMQRSLAQY AGEENRRQFRAIVAELHLLDPSSGHPFLSATMETAHRYTEDFY KCYLEKKREWLAKTFYRPEQDENTKRRISVFFVPDGEARKLLP LLIRRRMKEQNDLQDWIRNKQAHPIDLPSHLFDSKIMELLKVK DGKKKWNEAFKDWWSTKYPDGMQPFYGLRRELNIHGKSVSYIP SDGKKFADCYTHLMEKTVQDKKRELRTAGKPVPPDLAADIKRS FHRAVNEREFMLRLVQEDDRLMLMAINKMMTDREEDILPGLKN IDSILDEENQFSLAVHAKVLEKEGEGGDNSLSLVPATIEIKSK RKDWSKYIRYRYDRRVPGLMSHFPEHKATLDEVKTLLGEYDRC RIKIFDWAFALEGAIMSDRDLKPYLHESSSREGKSGEHSTLVK MLVEKKGCLTPDESQYLILIRNKAAHNQFPCAAEMPLIYRDVS |

TABLE 3-continued

| | | |
|---|---|---|
| | | AKVGSIEGSSAKDLPEGSSLVDSLWKKYEMIIRKILPILDPEN RFFGKLLNNMSQPINDL |
| Porphyromonas gingivalis (SEQ ID No. 109) | WP_005874195 | MTEQNEKPYNGTYYTLEDKHFWAAFFNLARHNAYITLAHIDRQ LAYSKADITNDEDILFFKGQWKNLDNDLERKARLRSLILKHFS FLEGAAYGKKLFESQSSGNKSSKKKELTKKEKEELQANALSLD NLKSILFDFLQKLKDFRNYYSHYRHPESSELPLFDGNMLQRLY NVFDVSVQRVKRDHEHNDKVDPHRHFNHLVRKGKKDKYGNNDN PFFKHHFVDREEKVTEAGLLFFVSLFLEKRDAIWMQKKIRGFK GGTEAYQQMTNEVFCRSRISLPKLKLESLRTDDWMLLDMLNEL VRCPKSLYDRLREEDRARFRVPVDILSDEDDTDGTEEDPFKNT LVRHQDRFPYFALRYFDLKKVFTSLRFHIDLGTYHFAIYKKNI GEQPEDRHLTRNLYGFGRIQDFAEEHRPEEWKRLVRDLDYFET GDKPYITQTTPHYHIEKGKIGLRFVPEGQLLWPSPEVGATRTG RSKYAQDKRFTAEAFLSVHELMPMMFYYFLLREKYSEEASAEK VQGRIKRVIEDVYAVYDAFARDEINTRDELDACLADKGIRRGH LPRQMIAILSQEHKDMEEKVRKKLQEMIADTDHRLDMLDRQTD RKIRIGRKNAGLPKSGVIADWLVRDMMRFQPVAKDTSGKPLNN SKANSTEYRMLQRALALFGGEKERLTPYFRQMNLTGGNNPHPF LHETRWESHTNILSFYRSYLKARKAFLQSIGRSDREENHRFLL LKEPKTDRQTLVAGWKSEFHLPRGIFTEAVRDCLIEMGYDEVG SYKEVGFMAKAVPLYFERACKDRVQPFYDYPFNVGNSLKPKKG RFLSKEKRAEEWESGKERFRDLEAWSHSAARRIEDAFVGIEYA SWENKKKIEQLLQDLSLWETFESKLKVKADKINIAKLKKEILE AKEHPYHDFKSWQKFERELRLVKNQDIITWMMCRDLMEENKVE GLDTGTLYLKDIRTDVQEQGSLNVLNHVKPMRLPVVVYRADSR GHVHKEEAPLATVYIEERDTKLLKQGNFKSFVKDRRLNGLFSF VDTGALAMEQYPISKLRVEYELAKYQTARVCAFEQTLELEESL LTRYPHLPDESFREMLESWSDPLLDKWPDLQREVRLLIAVRNA FSHNQYPMYDETIFSSIRKYDPSSLDAIEERMGLNIAHRLSEE VKLAKEMVERIIQA |
| Prevotella pallens (SEQ ID No. 110) | WP_006044833 | MKEEEKGKTPVVSTYNKDDKHFWAAFLNLARHNVYITVNHINK ILGEGEINRDGYENTLEKSWNEIKDINKKDRLSKLIIKHFPPFL EVTTYQRNSADTTKQKEEKQAEAQSLESLKKSFFVFIYKLRDL RNHYSHYKHSKSLERPKFEEDLQEKMYNIFDASIQLVKEDYKH NTDIKTEEDFKHLDRKGQFKYSFADNEGNITESGLLFFVSLFL EKKDAIWVQKKLEGFKCSNESYQKMTNEVFCRSRMLLPKLRLQ STQTQDWILLDMLNELIRCPKSLYERLREEDRKKFRVPIEIAD EDYDAEQEPFKNALVRHQDRFPYFALRYFDYNEIFTNLRFQID LGTYHFSIYKKQIGDYKESHHLTHKLYGFERIQEFTKQNRPDE WRKFVKTFNSFETSKEPYIPETTPHYHLENQKIGIRFRNDNDK IWPSLKTNSEKNEKSKYKLDKSFQAEAFLSVHELLPMMFYYLL LKTENTDNDNEIETKKKENKNDKQEKHKIEEIIENKITEIYAL YDAFANGKINSIDKLEEYCKGKDIEIGHLPKQMIAILKSEHKD MATEAKRKQEEMLADVQKSLESLDNQINEEIENVERKNSSLKS GEIASWLVNDMMRFQPVQKDNEGNPLNNSKANSTEYQMLQRSL ALYNKEEKPTRYFRQVNLIESSNPHPFLNNTEWEKCNNILSFY RSYLEAKKNFLESLKPEDWEKNQYFLMLKEPKTNCETLVQGWK NGFNLPRGIFTEPIRKWFMEHRKNITVAELKRVGLVAKVIPLF SEEYKDSVQPFYNYLFNVGNINKPDEKNFLNCEERRELLRKK KDEFKKMTDKEKEENPSYLEFQSWNKFERELRLVRNQDIVTWL LCMELFNKKKIKELNVEKIYLKNINTNTTKKEKNTEEKNGEEK IIKEKNNILNRIMPMRLPIKVYGRENFSKNKKKKIRRNTFFTV YIEEKGTKLLKQGNFKALERDRRLGGLFSFVKTHSKAESKSNT ISKSRVEYELGEYQKARIEIIKDMLALEETLIDKYNSLDTDNF HNMLTGWLKLKDEPDKASFQNDVDLLIAVRNAFSHNQYPMRNR IAFANINPFSLSSANTSEEKGLGIANQLKDKTHKTIEKIIEIE KPIETKE |
| Myroides odoratimimus (SEQ ID No. 111) | WP_006261414 | MKDILTTDTTEKQNRFYSHKIADKYFFGGYFNLASNNIYEVFE EVNKRNTFGKLAKRDNGNLKNYIIHVFKDELSISDFEKRVAIF ASYFPILETVDKKSIKERNRTIDLTLSQRIRQFREMLISLVTA VDQLRNFYTHYHHSEIVIENKVLDFLNSSLVSTALHVKDKYLK TDKTKEFLKETIAAELDILIEAYKKKQIEKKNTRFKANKREDI LNAIYNEAFWSFINDKDKDKETVVAKGADAYFEKNHHKSNDPD FALNISEKGIVYLLSFFLTNKEMDSLKANLTGFKGKVDRESGN SIKYMATQRIYSFHTYRGLKQKIRTSEEGVKETLLMQMIDELS KVPNVVYQHLSTTQQNSFIEDWNEYYKDYEDDVETDDLSRVIH PVIRKRYEDRFNYFAIRFLDEFFDFPTLRFQVHLGDYVHDRRT KQLGKVESDRIIKEKVTVFARLKDINSAKANYFHSLEEQDKEE LDNKWTLFPNPSYDFPKEHTLQHQGEQKNAGKIGIYVKLRDTQ YKEKAALEEARKSLNPKERSATKASKYDIITQIIEANDNVKSE KPLVFTGQPIAYLSMNDIHSMLFSLLTDNAELKKTPEEVEAKL IDQIGKQINEILSKDTDTKILKKYKDNDLKETDTDKITRDLAR DKEEIEKLILEQKQRADDYNYTSSTKFNIDKSRKRKHLLFNAE KGKIGVWLANDIKRFMTEEFKSKWKGYQHTELQKLFAYYDTSK SDLDLILSDMVMVKDYPIELIALVKKSRTLVDFLNKYLEARLG YMENVITRVKNSIGTPQFKTVRKECFTFLKKSNYTVVSLDKQV ERILSMPLFIERGFMDDKPTMLEGKSYQQHKEKFADWFVHYKE |

TABLE 3-continued

| | | |
|---|---|---|
| | | NSNYQNFYDTEVYEITTEDKREKAKVTKKIKQQQKNDVFTLMM<br>VNYMLEEVLKLSSNDRLSLNELYQTKEERIVNKQVAKDTQERN<br>KNYIWNKVVDLQLCEGLVRIDKVKLKDIGNFRKYENDSRVKEF<br>LTYQSDIVWSAYLSNEVDSNKLYVIERQLDNYESIRSKELLKE<br>VQEIECSVYNQVANKESLKQSGNENFKQYVLQGLVPIGMDVRE<br>MLILSTDVKFIKEEIIQLGQAGEVEQDLYSLIYIRNKFAHNQL<br>PIKEFFDFCENNYRSISDNEYYAEYYMEIFRSIKEKYTS |
| *Myroides odoratimimus* (SEQ ID No. 112) | WP_006265509 | MKDILTTDTTEKQNRFYSHKIADKYFFGGYFNLASNNIYEVFE<br>EVNKRNTFGKLAKRDNGNLKNYIIHVFKDELSISDFEKRVAIF<br>ASYFPILETVDKKSIKERNRTIDLTLSQRIRQFREMLISLVTA<br>VDQLRNFYTHYHHSEIVIENKVLDFLNSSLVSTALHVKDKYLK<br>TDKTKEFLKETIAAELDILIEAYKKKQIEKKNTRFKANKREDI<br>LNAIYNEAFWSFINDKDKDKETVVAKGADAYFEKNHHKSNDPD<br>FALNISEKGIVYLLSFFLTNKEMDSLKANLTGFKGKVDRESGN<br>SIKYMATQRIYSFHTYRGLKQKIRTSEEGVKETLLMQMIDELS<br>KVPNVVYQHLSTTQQNSFIEDWNEYYKDYEDDVETDDLSRVIH<br>PVIRKRYEDRFNYFAIRFLDEFFDFPTLRFQVHLGDYVHDRRT<br>KQLGKVESDRIIKEKVTVFARLKDINSAKASYFHSLEEQDKEE<br>LDNKWTLFPNPSYDFPKEHTLQHQGEQKNAGKIGIYVKLRDTQ<br>YKEKAALEEARKSLNPKERSATKASKYDIITQIIEANDNVKSE<br>KPLVFTGQPIAYLSMNDIHSMLFSLLTDNAELKKTPEEVEAKL<br>IDQIGKQINEILSKDTDTKILKKYKDNDLKETDTDKITRDLAR<br>DKEEIEKLILEQKQRADDYNYTSSTKFNIDKSRKRKHLLFNAE<br>KGKIGVWLANDIKRFMFKESKSKWKGYQHTELQKLFAYFDTSK<br>SDLELILSDMVMVKDYPIELIDLVRKSRTLVDFLNKYLEARLG<br>YIENVITRVKNSIGTPQFKTVRKECFAFLKESNYTVASLDKQI<br>ERILSMPLFIERGFMDSKPTMLEGKSYQQHKEDFADWFVHYKE<br>NSNYQNFYDTEVYEIITEDKREQAKVTKKIKQQQKNDVFTLMM<br>VNYMLEEVLKLPSNDRLSLNELYQTKEERIVNKQVAKDTQERN<br>KNYIWNKVVDLQLCEGLVRIDKVKLKDIGNFRKYENDSRVKEF<br>LTYQSDIVWSGYLSNEVDSNKLYVIERQLDNYESIRSKELLKE<br>VQEIECIVYNQVANKESLKQSGNENFKQYVLQGLLPRGTDVRE<br>MLILSTDVKFKKEEIMQLGQVREVEQDLYSLIYIRNKFAHNQL<br>PIKEFFDFCENNYRPISDNEYYAEYYMEIFRSIKEKYAS |
| *Prevotella sp. MSX73* (SEQ ID No. 113) | WP_007412163 | MQKQDKLFVDRKKNAIFAFPKYITIMENQEKPEPIYYELTDKH<br>FWAAFLNLARHNVYTTINHINRRLEIAELKDDGYMMGIKGSWN<br>EQAKKLDKKVRLRDLIMKHFPFLEAAAYEITNSKSPNNKEQRE<br>KEQSEALSLNNLKNVLFIFLEKLQVLRNYYSHYKYSEESPKPI<br>FETSLLKNMYKVFDANVRLVKRDYMHHENIDMQRDFTHLNRKK<br>QVGRTKNIIDSPNFHYHFADKEGNMTIAGLLFFVSFLFLDKKDA<br>IWMQKKLKGFKDGRNLREQMTNEVFCRSRISLPKLKLENVQTK<br>DWMQLDMLNELVRCPKSLYERLREKDRESFKVPFDIFSDDYDA<br>EEEPFKNTLVRHQDRFPYFVLRYFDLNEIFEQLRFQIDLGTYH<br>FSIYNKRIGDEDEVRHLTHHLYGFARIQDFAPQNQPEEWRKLV<br>KDLDHFETSQEPYISKTAPHYHLENEKIGIKFCSTHNNLFPSL<br>KREKTCNGRSKFNLGTQFTAEAFLSVHELLPMMFYYLLLTKDY<br>SRKESADKVEGIIRKEISNIYAIYDAFANNEINSIADLTCRLQ<br>KTNILQGHLPKQMISILEGRQKDMEKEAERKIGEMIDDTQRRL<br>DLLCKQTNQKIRIGKRNAGLLKSGKIADWLVSDMMRFQPVQKD<br>TNNAPINNSKANSTEYRMLQHALALFGSESSRLKAYFRQMNLV<br>GNANPHPFLAETQWEHQTNILSFYRNYLEARKKYLKGLKPQNW<br>KQYQHFLILKVQKTNRNTLVTGWKNSFNLPRGIFTQPIREWFE<br>KHNNSKRIYDQILSFDRVGFVAKAIPLYFAEEYKDNVQPFYDY<br>PFNIGNKLKPQKGQFLDKKERVELWQKNKELFKNYPSEKNKTD<br>LAYLDFLSWKKFERELRLIKNQDIVTWLMFKELFKTTTVEGLK<br>IGEIHLRDIDTNTANEESNNILNRIMPMKLPVKTYETDNKGNI<br>LKERPLATFYIEETETKVLKQGNFKVLAKDRRLNGLLSFAETT<br>DIDLEKNPITKLSVDYELIKYQTTRISIFEMTLGLEKKLIDKY<br>STLPTDSFRNMLERWLQCKANRPELKNYVNSLIAVRNAFSHNQ<br>YPMYDATLFAEVKKFTLPPSVDTKKIELNIAPQLLEIVGKAIK<br>EIEKSENKN |
| *Porphyromonas gingivalis* (SEQ ID No. 114) | WP_012458414 | MTEQNERPYNGTYYTLEDKHFWAAFFNLARHNAYITLAHIDRQ<br>LAYSKADITNDEDILFFKGQWKNLDNDLERKARLRSLILKHFS<br>FLEGAAYGKKLFESQSSGNKSSKKKELTKKEKEELQANALSLD<br>NLKSILFDFLQKLKDFRNYYSHYRHPESSELPLFDGNMLQRLY<br>NVFDVSVQRVKRDHEHNDKVDPHRHFNHLVRKGKKDRYGNNDN<br>PFFKHHFVDREEKVTEAGLLFFVSLFLEKRDAIWMQKKIRGFK<br>GGTETYQQMTNEVFCRSRISLPKLKLESLRTDDWMLLDMLNEL<br>VRCPKSLYDRLREEDRARFRVPVDILSDEDDTDGTEEDPFKNT<br>LVRHQDRFPYFALRYFDLKKVFTSLRFHIDLGTYHFAIYKKNI<br>GEQPEDRHLTRNLYGFGRIQDFAEEHRPEEWKRLVRDLDYFET<br>GDKPYITQTTPHYHIEKGKIGLRFVPEGQHLWPSPEVGATRTG<br>RSKYAQDKRLTAEAFLSVHELMPMMFYYFLLREKYSDEASAER<br>VQGRIKRVIEDVYAVYDAFARGEINTRDELDACLADKGIRRGH<br>LPRQMIGILSQEHKDMEEKVRKKLQEMIVDTDHRLDMLDRQTD<br>RKIRIGKRNAGLPKSGVIADWLVRDMMRFQPVAKDTSGKPLNN<br>SKANSTEYRMLQRALALFGGEKERLTPYFRQMNLTGGNNPHPF |

TABLE 3-continued

| | | |
|---|---|---|
| | | LHETRWESHTNILSFYRSYLKARKAFLQSIGRSDRVENHRFLL<br>LKEPKTDRQTLVAGWKGEFHLPRGIFTEAVRDCLIEMGLDEVG<br>SYKEVGFMAKAVPLYFERACKDRVQPFYDYPFNVGNSLKPKKG<br>RFLSKEKRAEEWESGKERFRLAKLKKEILEAKEHPYLDFKSWQ<br>KFERELRLVKNQDIITWMICRDLMEENKVEGLDTGTLYLKDIR<br>TDVQEQGNLNVLNRVKPMRLPVVVYRADSRGHVHKEQAPLATV<br>YIEERDTKLLKQGNFKSFVKDRRLNGLFSFVDTGALAMEQYPI<br>SKLRVEYELAKYQTARVCAFEQTLELEESLLTRYPHLPDKNFR<br>KMLESWSDPLLDKWPDLHGNVRLLIAVRNAFSHNQYPMYDEAV<br>FSSIRKYDPSSPDAIEERMGLNIAHRLSEEVKQAKEMAERIIQ<br>A |
| Paludibacter<br>propionicigenes<br>(SEQ ID<br>No. 115) | WP_013446107 | MKTSANNIYFNGINSFKKIFDSKGAIAPIAEKSCRNFDIKAQN<br>DVNKEQRIHYFAVGHTFKQLDTENLFEYVLDENLRAKRPTRFI<br>SLQQFDKEFIENIKRLISDIRNINSHYIHRFDPLKIDAVPTNI<br>IDFLKESFELAVIQIYLKEKGINYLQFSENPHADQKLVAFLHD<br>KFLPLDEKKTSMLQNETPQLKEYKEYRKYFKTLSKQAAIDQLL<br>FAEKETDYIWNLFDSHPVLTISAGKYLSFYSCLFLLSMFLYKS<br>EANQLISKIKGFKKNTTEEEKSKREIFTFFSKRFNSMDIDSEE<br>NQLVKFRDLILYLNHYPVAWNKDLELDSSNPAMTDKLKSKIIE<br>LEINRSFPLYEGNERFATFAKYQIWGKKHLGKSIEKEYINASF<br>TDEEITAYTYETDTCPELKDAHKKLADLKAAKGLFGKRKEKNE<br>SDIKKTETSIRELQHEPNPIKDKLIQRIEKNLLTVSYGRNQDR<br>FMDFSARFLAEINYFGQDASFKMYHFYATDEQNSELEKYELPK<br>DKKKYDSLKFHQGKLVHFISYKEHLKRYESWDDAFVIENNAIQ<br>LKLSFDGVENTVTIQRALLIYLLEDALRNIQNNTAENAGKQLL<br>QEYYSHNKADLSAFKQILTQQDSIEPQQKTEFKKLLPRRLLNN<br>YSPAINHLQTPHSSLPLILEKALLAEKRYCSLVVKAKAEGNYD<br>DFIKRNKGKQFKLQFIRKAWNLMYFRNSYLQNVQAAGHHKSFH<br>IERDEFNDFSRYMFAFEELSQYKYYLNEMFEKKGFFENNEFKI<br>LFQSGTSLENLYEKTKQKFEIWLASNTAKTNKPDNYHLNNYEQ<br>QFSNQLFFINLSHFINYLKSTGKLQTDANGQIIYEALNNVQYL<br>IPEYYYTDKPERSESKSGNKLYNKLKATKLEDALLYEMAMCYL<br>KADKQIADKAKHPITKLLTSDVEFNITNKEGIQLYHLLVPFKK<br>IDAFIGLKMHKEQQDKKHPTSFLANIVNYLELVKNDKDIRKTY<br>EAFSTNPVKRTLTYDDLAKIDGHLISKSIKFTNVTLELERYFI<br>FKESLIVKKGNNIDFKYIKGLRNYYNNEKKKNEGIRNKAFHFG<br>IPDSKSYDQLIRDAEVMFIANEVKPTHATKYTDLNKQLHTVCD<br>KLMETVHNDYFSKEGDGKKKREAAGQKYFENIISAK |
| Porphyromonas<br>gingivalis<br>(SEQ ID<br>No. 116) | WP_013816155 | MTEQNEKPYNGTYYTLEDKHFWAAFFNLARHNAYITLAHIDRQ<br>LAYSKADITNDEDILFFKGQWKNLDNDLERKARLRSLILKHFS<br>FLEGAAYGKKLFESQSSGNKSSKNKELTKKEKEELQANALSLD<br>NLKSILFDFLQKLKDFRNYYSHYRHPESSELPLFDGNMLQRLY<br>NVFDVSVQRVKRDHENDKVDPHRHFNHLVRKGKKDRYGNNDN<br>PFFKHHFVDREGTVTEAGLLFFVSLFLEKRDAIWMQKKIRGFK<br>GGTETYQQMTNEVFCRSRISLPKLKLESLRTDDWMLLDMLNEL<br>VRCPKSLYDRLREEDRARFRVPVDILSDEEDTDGAEEDPFKNT<br>LVRHQDRFPYFALRYFDLKKVFTSLRFQIDLGTYHFAIYKKNI<br>GEQPEDRHLTRNLYGFGRIQDFAEEHRPEEWKRLVRDLDYFET<br>GDKPYITQTTPHYHIEKGKIGLRFVPEGQHLWPSPEVGATRTG<br>RSKYAQDKRFTAEAFLSAHELMPMMFYYFLLREKYSEEASAER<br>VQGRIKRVIEDVYAVYDAFARDEINTRDELDACLADKGIRRGH<br>LPRQMIGILSQEHKDMEEKIRKKLQEMMADTDHRLDMLDRQTD<br>RKIRIGRKNAGLPKSGVIADWLVRDMMRFQPVAKDTSGKPLNN<br>SKANSTEYRMLQRALALFGGEKERLTPYFRQMNLTGGNNPHPF<br>LHETRWESHTNILSFYRSYLKARKAFLQSIGRSDRVENHRFLL<br>LKEPKTDRQTLVAGWKGEFHLPRGIFTEAVRDCLIEMGLDEVG<br>SYKEVGFMAKAVPLYFERACKDWVQPFYNYPFNVGNSLKPKKG<br>RFLSKEKRAEEWESGKERFRLAKLKKEILEAKEHPYLDFKSWQ<br>KFERELRLVKNQDIITWMICGDLMEENKVEGLDTGTLYLKDIR<br>TDVQEQGSLNVLNRVKPMRLPVVVYRADSRGHVHKEQAPLATV<br>YIEERDTKLLKQGNFKSFVKDRRLNGLFSFVDTGALAMEQYPI<br>SKLRVEYELAKYQTARVCAFEQTLELEESLLTRCPHLPDKNFR<br>KMLESWSDPLLDKWPDLHRKVRLLIAVRNAFSHNQYPMYDEAV<br>FSSIRKYDPSFPDAIEERMGLNIAHRLSEEVKQAKETVERIIQ<br>A |
| Flavobacterium<br>columnare<br>(SEQ ID<br>No. 117) | WP_014165541 | MSSKNESYNKQKTFNHYKQEDKYFFGGFLNNADDNLRQVGKEF<br>KTRINFNHNNNELASVFKDYFNKEKSVAKREHALNLLSNYFPV<br>LERIQKHTNHNFEQTREIFELLLDTIKKLRDYYTHHYHKPITI<br>NPKIYDFLDDTLLDVLITIKKKKVKNDTSRELLKEKLRPELTQ<br>LKNQKREELIKKGKKLLEENLENAVFNHCLRPFLEENKTDDKQ<br>NKTVSLRKYRSKPNEETSITLTQSGLVFLMSFFLHRKEFQVF<br>TSGLEGFKAKVNTIKEEEISLNKNNIVYMITHWSYSYYNFKGL<br>KHRIKTDQGVSTLEQNNTTHSLTNTNTKEALLTQIVDYLSKVP<br>NEIYETLSEKQQKEFEEDINEYMRENPENEDSTFSSIVSHKVI<br>RKRYENKFNYFAMRFLDEYAELPTLRFMVNFGDYIKDRQKKIL<br>ESIQFDSEMIKKEIHLFEKLSLVTEYKKNVYLKETSNIDLSRF<br>PLFPNPSYVMANNNIPFYIDSRSNNLDEYLNQKKKAQSQNKKR |

TABLE 3-continued

| | | |
|---|---|---|
| | | NLTFEKYNKEQSKDAIIAMLQKEIGVKDLQQRSTIGLLSCNEL
PSMLYEVIVKDIKGAELENKIAQKIREQYQSIRDFTLDSPQKD
NIPTTLIKTINTDSSVTFENQPIDIPRLKNAIQKELTLTQEKL
LNVKEHEIEVDNYNRNKNTYKFKNQPKNKVDDKKLQRKYVFYR
NEIRQEANWLASDLIHFMKNKSLWKGYMHNELQSFLAFFEDKK
NDCIALLETVFNLKEDCILTKGLKNLFLKHGNFIDFYKEYLKL
KEDFLNTESTFLENGLIGLPPKILKKELSKRFKYIFIVFQKRQ
FIIKELEEKKNNLYADAINLSRGIFDEKPTMIPFKKPNPDEFA
SWFVASYQYNNYQSFYELTPDIVERDKKKKYKNLRAINKVKIQ
DYYLKLMVDTLYQDLFNQPLDKSLSDFYVSKAEREKIKADAKA
YQKRNDSSLWNKVIHLSLQNNRITANPKLKDIGKYKRALQDEK
IATLLTYDDRTWTYALQKPEKENENDYKELHYTALNMELQEYE
KVRSKELLKQVQELEKQILEEYTDFLSTQIHPADFEREGNPNF
KKYLAHSILENEDDLDKLPEKVEAMRELDETITNPIIKKAIVL
IIIRNKMAHNQYPPKFIYDLANRFVPKKEEEYFATYFNRVFET
ITKELWENKEKKDKTQV |
| *Psychroflexus torquis* (SEQ ID No. 118) | WP_015024765 | MESIIGLGLSFNPYKTADKHYFGSFLNLVENNLNAVFAEFKER
ISYKAKDENISSLIEKHFIDNMSIVDYEKKISILNGYLPIIDF
LDDELENNLNTRVKNFKKNFIILAEAIEKLRDYYTHFYHDPIT
FEDNKEPLLELLDEVLLKTILDVKKKYLKTDKTKEILKDSLRE
EMDLLVIRKTDELREKKKTNPKIQHTDSSQIKNSIFNDAFQGL
LYEDKGNNKKTQVSHRAKTRLNPKDIHKQEERDFEIPLSTSGL
VFLMSLFLSKKEIEDFKSNIKGFKGKVVKDENHNSLKYMATHR
VYSILAFKGLKYRIKTDTFSKETLMMQMIDELSKVPDCVYQNL
SETKQKDFIEDWNEYFKDNEENTENLENSRVVHPVIRKRYEDK
FNYFAIRFLDEFANFKTLKFQVFMGYYIHDQRTKTIGTTNITT
ERTVKEKINVFGKLSKMDNLKKHFFSQLSDDENTDWEFFPNPS
YNFLTQADNSPANNIPIYLELKNQQIIKEKDAIKAEVNQTQNR
NPNKPSKRDLLNKILKTYEDFHQGDPTAILSLNEIPALLHLFL
VKPNNKTGQQIENIIRIKIEKQPFKAINHPSKNNKGIPKSLFAD
TNVRVNAIKLKKDLEAELDMLNKKHIAFKENQKASSNYDKLLK
EHQFTPKNKRPELRKYVFYKSEKGEEATWLANDIKRFMPKDFK
TKWKGCQHSELQRKLAFYDRHTKQDIKELLSGCEFDHSLLDIN
AYFQKDNFEDFFSKYLENRIETLEGVLKKLHDFKNEPTPLKGV
FKNCFKFLKRQNYVTESPEIIKKRILAKPTFLPRGVFDERPTM
KKGKNPLKDKNEFAEWFVEYLENKDYQKFYNAEEYRMRDADFK
KNAVIKKQKLKDFYTLQMVNYLLKEVFGKDEMNLQLSELFQTR
QERLKLQGIAKKQMNKETGDSSENTRNQTYIWNKDVPVSFFNG
KVTIDKVKLKNIGKYKRYERDERVKTFIGYEVDEKWMMYLPHN
WKDRYSVKPINVIDLQIQEYEEIRSHELLKEIQNLEQYIYDHT
TDKNILLQDGNPNFKMYVLNGLLIGIKQVNIPDFIVLKQNTNF
DKIDFTGIASCSELEKKTIILIAIRNKFAHNQLPNKMIYDLAN
EFLKIEKNETYANYYLKVLKKMISDLA |
| *Riemerella anatipestifer* (SEQ ID No. 119) | WP_015345620 | MFFSFHNAQRVIFKHLYKAFDASLRMVKEDYKAHFTVNLTRDF
AHLNRKGKNKQDNPDFNRYRFEKDGFFTESGLLFFTNLFLDKR
DAYWMLKKVSGFKASHKQREKMTTEVFCRSRILLPKLRLESRY
DHNQMLLDMLSELSRCPKLLYEKLSEENKKHFQVEADGFLDEI
EEEQNPFKDTLIRHQDRFPYFALRYLDLNESFKSIRFQVDLGT
YHYCIYDKKIGDEQEKRHLTRTLLSFGRLQDFTEINRPQEWKA
LTKDLDYKETSNQPFISKTTPHYHITDNKIGFRLGTSKELYPS
LEIKDGANRIAKYPYNSGFVAHAFISVHELLPLMFYQHLTGKS
EDLLKETVRHIQRIYKDFEEERINTIEDLEKANQGRLPLGAFP
KQMLGLLQNKQPDLSEKAKIKIEKLIAETKLLSHRLNTKLKSS
PKLGKRREKLIKTGVLADWLVKDFMRFQPVAYDAQNQPIKSSK
ANSTEFWFIRRALALYGGEKNRLEGYFKQTNLIGNTNPHPFLN
KFNWKACRNLVDFYQQYLEQREKFLEAIKHQPWEPYQYCLLLK
VPKENRKNLVKGWEQGGISLPRGLFTEAIRETLSKDLTLSKPI
RKEIKKHGRVGFISRAITLYFKEKYQDKHQSFYNLSYKLEAKA
PLLKKEEHYEYWQQNKPQSPTESQRLELHTSDRWKDYLLYKRW
QHLEKKLRLYRNQDIMLWLMTLELTKNHPKELNLNYHQLKLEN
LAVNVQEADAKLNPLNQTLPMVLPVKVYPTTAFGEVQKHETPI
RTVYIREEQTKALKMGNFKALVKDRRLNGLFSFIKEENDTQKH
PISQLRLRRELEIYQSLRVDAFKETLSLEEKLLNKHASLSSLE
NEFRTLLEEWKKKYAASSMVTDKHIAFIASVRNAFCHNQYPFY
KETLHAPILLFTVAQPTTEEKDGLGIAEALLKVLREYCEIVKS
QI |
| *Prevotella pleuritidis* (SEQ ID No. 120) | WP_021584635 | MENDKRLEESACYTLNDKHFWAAFLNLARHNVYITVNHINKTL
ELKNKKNQEIIIDNDQDILAIKTHWAKVNGDLNKTDRLRELMI
KHFPFLEAAIYSNNKEDKEEVKEEKQAKAQSFKSLKDCLFLFL
EKLQEARNYYSHYKYSESSKEPEFEEGLLEKMYNTFDASIRLV
KEDYQYNKDIDPEKDFKHLERKEDFNYLFTDKDNKGKITKNGL
LFFVSLFLEKKDAIWMQQKFRGFKDNRGNKEKMTHEVFCRSRM
LLPKIRLESTQTQDWILLDMLNELIRCPKSLYERLQGAYREKF
KVPFDSIDEDYDAEQEPFRNTLVRHQDRFPYFALRYFDYNEIF
KNLRFQIDLGTYHFSIYKKLIGGKKEDRHLTHKLYGFERIQEF
TKQNRPDKWQAIIKDLDTYETSNERYISETTPHYHLENQKIGI
RFRNDNNDIWPSLKTNGEKNEKSKYNLDKPYQAEAFLSVHELL |

TABLE 3-continued

| | | |
|---|---|---|
| | | PMMFYYLLLKMENTDNDKEDNEVGTKKKGNKNNKQEKHKIEEI<br>IENKIKDIYALYDAFTNGEINSIDELAEQREGKDIEIGHLPKQ<br>LIVILKNKSKDMAEKANRKQKEMIKDTKKRLATLDKQVKGEIE<br>DGGRNIRLLKSGEIARWLVNDMMRFQPVQKDNEGKPLNNSKAN<br>STEYQMLQRSLALYNKEEKPTRYFRQVNLIKSSNPHPFLEDTK<br>WEECYNILSFYRNYLKAKIKFLNKLKPEDWKKNQYFLMLKEPK<br>TNRKTLVQGWKNGFNLPRGIFTEPIKEWFKRHQNDSEEYKKVE<br>ALDRVGLVAKVIPLFFKEEYFKEDAQKEINNCVQPFYSFPYNV<br>GNIHKPEEKNFLHCEERRKLWDKKKDKFKGYKAKEKSKKMTDK<br>EKEEHRSYLEFQSWNKFERELRLVRNQDILTWLLCTKLIDKLK<br>IDELNIEELQKLRLKDIDTDTAKKEKNNILNRVMPMRLPVTVY<br>EIDKSFNIVKDKPLHTVYIEETGTKLLKQGNFKALVKDRRLNG<br>LFSFVKTSSEAESKSKPISKLRVEYELGAYQKARIDIIKDMLA<br>LEKTLIDNDENLPTNKFSDMLKSWLKGKGEANKARLQNDVGLL<br>VAVRNAFSHNQYPMYNSEVFKGMKLLSLSSDIPEKEGLGIAKQ<br>LKDKIKETIERIIEIEKEIRN |
| Porphyromonas<br>gingivalis<br>(SEQ ID<br>No. 121) | WP_021663197 | MNTVPASENKGQSRTVEDDPQYFGLYLNLARENLIEVESHVRI<br>KFGKKKLNEESLKQSLLCDHLLSVDRWTKVYGHSRRYLPFLHY<br>FDPDSQIEKDHDSKTGVDPDSAQRLIRELYSLLDFLRNDFSHN<br>RLDGTTFEHLEVSPDISSFITGTYSLACGRAQSRFADFFKPDD<br>FVLAKNRKEQLISVADGKECLTVSGLAFFICLFLDREQASGML<br>SRIRGFKRTDENWARAVHETFCDLCIRHPDRLESSNTKEALL<br>LDMLNELNRCPRILYDMLPEEERAQFLPALDENSMNNLSENSL<br>NEESRLLWDGSSDWAEALTKRIRHQDRFPYLMLRFIEEMDLLK<br>GIRFRVDLGEIELDSYSKKVGRNGEYDRTITDHALAFGKLSDF<br>QNEEEVSRMISGEASYPVRFSLFAPRYAIYDNKIGYCHTSDPV<br>YPKSKTGEKRALSNPRSMGFISVHDLRKLLLMELLCEGSFSRM<br>QSDFLRKANRILDETAEGKLQFSALFPEMRHRFIPPQNPKSKD<br>RREKAETTLEKYKQEIKGRKDKLNSQLLSAFDMDQRQLPSRLL<br>DEWMNIRPASHSVKLRTYVKQLNEDCRLRLQKFRKDGDGKARA<br>IPLVGEMATFLSQDIVIMIISEETKKLITSAYYNEMQRSLAQY<br>AGEENRHQFRAIVAELRLLDPSSGHPFLSATMETAHRYTEDFY<br>KCYLEKKREWLAKTFYRPEQDENTKRRISVFFVPDGEARKLLP<br>LLIRRRMKEQNDLQDWIRNKQAHPIDLPSHLFDSKIMELLKVK<br>DGKKKWNEAFKDWWSTKYPDGMQPFYGLRRELNIHGKSVSYIP<br>SDGKKFADCYTHLMEKTVQDKKRELRTAGKPVPPDLAADIKRS<br>FHRAVNEREFMLRLVQEDDRLMLMAINKMMTDREEDILPGLKN<br>IDSILDEENQFSLAVHAKVLEKEGEGGDNSLSLVPATIEIKSK<br>RKDWSKYIRYRYDRRVPGLMSHFPEHKATLDEVKTLLGEYDRC<br>RIKIFDWAFALEGAIMSDRDLKPYLHESSSREGKSGEHSTLVK<br>MLVEKKGCLTPDESQYLILIRNKAAHNQFPCAAEMPLIYRDVS<br>AKVGSIEGSSAKDLPEGSSLVDSLWKKYEMIIRKILPILDPEN<br>RFFGKLLNNMSQPINDL |
| Porphyromonas<br>gingivalis<br>(SEQ ID<br>No. 122) | WP_021665475 | MNTVPASENKGQSRTVEDDPQYFGLYLNLARENLIEVESHVRI<br>KFGKKKLNEESLKQSLLCDHLLSVDRWTKVYGHSRRYLPFLHY<br>FDPDSQIEKDHDSKTGVDPDSAQRLIRELYSLLDFLRNDFSHN<br>RLDGTTFEHLEVSPDISSFITGTYSLACGRAQSRFADFFKPDD<br>FVLAKNRKEQLISVADGKECLTVSGLAFFICLFLDREQASGML<br>SRIRGFKRTNENWARAVHETFCDLCIRHPDRLESSNTKEALL<br>LDMLNELNRCPRILYDMLPEEERAQFLPALDENSMNNLSENSL<br>NEESRLLWDGSSDWAEALTKRIRHQDRFPYLMLRFIEEMDLLK<br>GIRFRVDLGEIELDSYSKKVGRNGEYDRTITDHALAFGKLSDF<br>QNEEEVSRMISGEASYPVRFSLFAPRYAIYDNKIGYCHTSDPV<br>YPKSKTGEKRALSNPQSMGFISVHDLRKLLLMELLCEGSFSRM<br>QSGFLRKANRILDETAEGKLQFSALFPEMRHRFIPPQNPKSKD<br>RREKAETTLEKYKQEIKGRKDKLNSQLLSAFDMNQRQLPSRLL<br>DEWMNIRPASHSVKLRTYVKQLNEDCRLRLRKFRKDGDGKARA<br>IPLVGEMATFLSQDIVIMIISEETKKLITSAYYNEMQRSLAQY<br>AGEENRRQFRAIVAELHLLDPSSGHPFLSATMETAHRYTEDFY<br>KCYLEKKREWLAKTFYRPEQDENTKRRISVFFVPDGEARKLLP<br>LLIRRRMKEQNDLQDWIRNKQAHPIDLPSHLFDSKIMELLKVK<br>DGKKKWNEAFKDWWSTKYPDGMQPFYGLRRELNIHGKSVSYIP<br>SDGKKFADCYTHLMEKTVQDKKRELRTAGKPVPPDLAADIKRS<br>FHRAVNEREFMLRLVQEDDRLMLMAINKMMTDREEDILPGLKN<br>IDSILDKENQFSLAVHAKVLEKEGEGGDNSLSLVPATIEIKSK<br>RKDWSKYIRYRYDRRVPGLMSHFPEHKATLDEVKTLLGEYDRC<br>RIKIFDWAFALEGAIMSDRDLKPYLHESSSREGKSGEHSTLVK<br>MLVEKKGCLTPDESQYLILIRNKAAHNQFPCAAEMPLIYRDVS<br>AKVGSIEGSSAKDLPEGSSLVDSLWKKYEMIIRKILPILDHEN<br>RFFGKLLNNMSQPINDL |
| Porphyromonas<br>gingivalis<br>(SEQ ID<br>No. 123) | WP_021677657 | MNTVPASENKGQSRTVEDDPQYFGLYLNLARENLIEVESHVRI<br>KFGKKKLNEESLKQSLLCDHLLSVDRWTKVYGHSRRYLPFLHY<br>FDPDSQIEKDHDSKTGVDPDSAQRLIRELYSLLDFLRNDFSHN<br>RLDGTTFEHLEVSPDISSFITGTYSLACGRAQSRFADFFKPDD<br>FVLAKNRKEQLISVADGKECLTVSGLAFFICLFLDREQASGML<br>SRIRGFKRTDENWARAVHETFCDLCIRHPDRLESSNTKEALL<br>LDMLNELNRCPRILYDMLPEEERAQFLPALDENSMNNLSENSL |

TABLE 3-continued

| | | |
|---|---|---|
| | | NEESRLLWDGSSDWAEALTKRIRHQDRFPYLMLRFIEEMDLLK<br>GIRFRVDLGEIELDSYSKKVGRNGEYDRTITDHALAFGKLSDF<br>QNEEEVSRMISGEASYPVRFSLFAPRYAIYDNKIGYCHTSDPV<br>YPKSKTGEKRALSNPQSMGFISVHDLRKLLLMELLCEGSFSRM<br>QSGFLRKANRILDETAEGKLQFSALFPEMRHRFIPPQNPKSKD<br>RREKAETTLEKYKQEIKGRKDKLNSQLLSAFDMNQRQLPSRLL<br>DEWMNIRPASHSVKLRTYVKQLNEDCRLRLRKFRKDGDGKARA<br>IPLVGEMATFLSQDIVRMIISEETKKLITSAYYNEMQRSLAQY<br>AGEENRRQFRAIVAELHLLDPSSGHPFLSATMETAHRYTEDFY<br>KCYLEKKREWLAKTFYRPEQDENTKRRISVFFVPDGEARKLLP<br>LLIRRRMKEQNDLQDWIRNKQAHPIDLPSHLFDSKIMELLKVK<br>DGKKKWNEAFKDWWSTKYPDGMQPFYGLRRELNIHGKSVSYIP<br>SDGKKFADCYTHLMEKTVQDKKRELRTAGKPVPPDLAADIKRS<br>FHRAVNEREFMLRLVQEDDRLMLMAINKMMTDREEDILPGLKN<br>IDSILDEENQFSLAVHAKVLEKEGEGGDNSLSLVPATIEIKSK<br>RKDWSKYIRYRYDRRVPGLMSHFPEHKATLDEVKTLLGEYDRC<br>RIKIFDWAFALEGAIMSDRDLKPYLHESSSREGKSGEHSTLVK<br>MLVEKKGCLTPDESQYLILIRNKAAHNQFPCAAEMPLIYRDVS<br>AKVGSIEGSSAKDLPEGSSLVDSLWKKYEMIIRKILPILDHEN<br>RFFGKLLNNMSQPINDL |
| Porphyromonas<br>gingivalis<br>(SEQ ID<br>No. 124) | WP_021680012 | MNTVPASENKGQSRTVEDDPQYFGLYLNLARENLIEVESHVRI<br>KFGKKKLNEESLKQSLLCDHLLSVDRWTKVYGHSRRYLPFLHY<br>FDPDSQIEKDHDSKTGVDPDSAQRLIRELYSLLDFLRNDFSHN<br>RLDGTTFEHLEVSPDISSFITGTYSLACGRAQSRFADFFKPDD<br>FVLAKNRKEQLISVADGKECLTVSGLAFFICLFLDREQASGML<br>SRIRGFKRTDENWARAVHETFCDLCIRHPDRLESSNTKEALL<br>LDMLNELNRCPRILYDMLPEEERAQFLPALDENSMNNLSENSL<br>NEESRLLWDGSSDWAEALTKRIRHQDRFPYLMLRFIEEMDLLK<br>GIRFRVDLGEIELDSYSKKVGRNGEYDRTITDHALAFGKLSDF<br>QNEEEVSRMISGEASYPVRFSLFAPRYAIYDNKIGYCHTSDPV<br>YPKSKTGEKRALSNPRSMGFISVHDLRKLLLMELLCEGSFSRM<br>QSDFLRKANRILDETAEGKLQFSALFPEMRHRFIPPQNPKSKD<br>RREKAETTLEKYKQEIKGRKDKLNSQLLSAFDMDQRQLPSRLL<br>DEWMNIRPASHSVKLRTYVKQLNEDCRLRLQKFRKDGDGKARA<br>IPLVGEMATFLSQDIVRMIISEETKKLITSAYYNEMQRSLAQY<br>AGEENRHQFRAIVAELRLLDPSSGHPFLSATMETAHRYTEDFY<br>KCYLEKKREWLAKTFYRPEQDENTKRRISVFFVPDGEARKLLP<br>LLIRRRMKEQNDLQDWIRNKQAHPIDLPSHLFDSKVMELLKVK<br>DGKKKWNEAFKDWWSTKYPDGMQPFYGLRRELNIHGKSVSYIP<br>SDGKKFADCYTHLMEKTVRDKKRELRTAGKPVPPDLAAYIKRS<br>FHRAVNEREFMLRLVQEDDRLMLMAINKIMTDREEDILPGLKN<br>IDSILDKENQFSLAVHAKVLEKEGEGGDNSLSLVPATIEIKSK<br>RKDWSKYIRYRYDRRVPGLMSHFPEHKATLDEVKTLLGEYDRC<br>RIKIFDWAFALEGAIMSDRDLKPYLHESSSREGKSGEHSTLVK<br>MLVEKKGCLTPDESQYLILIRNKAAHNQFPCAAEIPLIYRDVS<br>AKVGSIEGSSAKDLPEGSSLVDSLWKKYEMIIRKILPILDPEN<br>RFFGKLLNNMSQPINDL |
| Porphyromonas<br>gingivalis<br>(SEQ ID<br>No. 125) | WP_023846767 | MNTVPASENKGQSRTVEDDPQYFGLYLNLARENLIEVESHVRI<br>KFGKKKLNEESLKQSLLCDHLLSVDRWTKVYGHSRRYLPFLHY<br>FDPDSQIEKDHDSKTGVDPDSAQRLIRELYSLLDFLRNDFSHN<br>RLDGTTFEHLEVSPDISSFITGTYSLACGRAQSRFADFFKPDD<br>FVLAKNRKEQLISVADGKECLTVSGLAFFICLFLDREQASGML<br>SRIRGFKRTDENWARAVHETFCDLCIRHPDRLESSNTKEALL<br>LDMLNELNRCPRILYDMLPEEERAQFLPALDENSMNNLSENSL<br>NEESRLLWDGSSDWAEALTKRIRHQDRFPYLMLRFIEEMDLLK<br>GIRFRVDLGEIELDSYSKKVGRNGEYDRTITDHALAFGKLSDF<br>QNEEEVSRMISGEASYPVRFSLFAPRYAIYDNKIGYCHTSDPV<br>YPKSKTGEKRALSNPRSMGFISVHDLRKLLLMELLCEGSFSRM<br>QSDFLRKANRILDETAEGKLQFSALFPEMRHRFIPPQNPKSKD<br>RREKAETTLEKYKQEIKGRKDKLNSQLLSAFDMNQRQLPSRLL<br>DEWMNIRPASHSVKLRTYVKQLNEDCRLRLRKFRKDGDGKARA<br>IPLVGEMATFLSQDIVRMIISEETKKLITSAYYNEMQRSLAQY<br>AGEENRRQFRAIVAELHLLDPSSGHPFLSATMETAHRYTEDFY<br>KCYLEKKREWLAKTFYRPEQDENTKRRISVFFVPDGEARKLLP<br>LLIRRRMKEQNDLQDWIRNKQAHPIDLPSHLFDSKIMELLKVK<br>DGKKKWNEAFKDWWSTKYPDGMQPFYGLRRELNIHGKSVSYIP<br>SDGKKFADCYTHLMEKTVQDKKRELRTAGKPVPPDLAADIKRS<br>FHRAVNEREFMLRLVQEDDRLMLMAINKMMTDREEDILPGLKN<br>IDSILDEENQFSLAVHAKVLEKEGEGGDNSLSLVPATIEIKSK<br>RKDWSKYIRYRYDRRVPGLMSHFPEHKATLDEVKTLLGEYDRC<br>RIKIFDWAFALEGAIMSDRDLKPYLHESSSREGKSGEHSTLVK<br>MLVEKKGCLTPDESQYLILIRNKAAHNQFPCAAEMPLIYRDVS<br>AKVGSIEGSSAKDLPEGSSLVDSLWKKYEMIIRKILPILDPEN<br>RFFGKLLNNMSQPINDL |
| Prevotella<br>falsenii<br>(SEQ ID | WP_036884929 | MKNDNNSTKSTDYTLGDKHFWAAFLNLARHNVYITVNHINKVL<br>ELKNKKDQEIIIDNDQDILAIKTLWGKVDTDINKKDRLRELIM<br>KHFPFLEAATYQQSSTNNTKQKEEEQAKAQSFESLKDCLFLFL |

TABLE 3-continued

| | | |
|---|---|---|
| No. 126) | | EKLREARNYYSHYKHSKSLEEPKLEEKLLENMYNIFDTNVQLV<br>IKDYEHNKDINPEEDFKHLGRAEGEFNYYFTRNKKGNITESGL<br>LFFVSLFLEKKDAIWAQTKIKGFKDNRENKQKMTHEVFCRSRM<br>LLPKLRLESTQTQDWILLDMLNELIRCPKSLYKRLQGEKREKF<br>RVPFDPADEDYDAEQEPFKNTLVRHQDRFPYFALRYFDYNEIF<br>TNLRFQIDLGTYHFSIYKKQIGDKKEDRHLTHKLYGFERIQEF<br>AKENRPDEWKALVKDLDTFEESNEPYISETTPHYHLENQKIGI<br>RNKNKKKKTIWPSLETKTTVNERSKYNLGKSFKAEAFLSVHE<br>LLPMMFYYLLLNKEEPNNGKINASKVEGIIEKKIRDIYKLYGA<br>FANEEINNEEELKEYCEGKDIAIRHLPKQMIAILKNEYKDMAK<br>KAEDKQKKMIKDTKKRLAALDKQVKGEVEDGGRNIKPLKSGRI<br>ASWLVNDMMRFQPVQRDRDGYPLNNSKANSTEYQLLQRTLALF<br>GSERERLAPYFRQMNLIGKDNPHPFLKDTKWKEHNNILSFYRS<br>YLEAKKNFLGSLKPEDWKKNQYFLKLKEPKTNRETLVQGWKNG<br>FNLPRGIFTEPIREWFIRHQNESEEYKKVKDFDRIGLVAKVIP<br>LFFKEDYQKEIEDYVQPFYGYPFNVGNIHNSQEGTFLNKKERE<br>ELWKGNKTKFKDYKTKEKNKEKTNKDKFKKKTDEEKEEFRSYL<br>DFQSWKKFERELRLVRNQDIVTWLLCMELIDKLKIDELNIEEL<br>QKLRLKDIDTDTAKKEKNNILNRIMPMELPVTVYETDDSNNII<br>KDKPLHTIYIKEAETKLLKQGNFKALVKDRRLNGLFSFVETSS<br>EAELKSKPISKSLVEYELGEYQRARVEIIKDMLRLEETLIGND<br>EKLPTNKFRQMLDKWLEHKKETDDTDLKNDVKLLTEVRNAFSH<br>NQYPMRDRIAFANIKPFSLSSANTSNEEGLGIAKKLKDKTKET<br>IDRIIEIEEQTATKR |
| Prevotella<br>pleuritidis<br>(SEQ ID<br>No. 127) | WP_036931485 | MENDKRLEESTCYTLNDKHFWAAFLNLARHNVYITINHINKLL<br>EIRQIDNDEKVLDIKALWQKVDKDINQKARLRELMIKHFPFLE<br>AAIYSNNKEDKEEVKEEKQAKAQSFKSLKDCLFLFLEKLQEAR<br>NYYSHYKSSESSKEPEFEEGLLEKMYNTFGVSIRLVKEDYQYN<br>KDIDPEKDFKHLERKEDFNYLFTDKDNKGKITKNGLLFFVSLF<br>LEKKDAIWMQQKLRGFKDNRGNKEKMTHEVFCRSRMLLPKIRL<br>ESTQTQDWILLDMLNELIRCPKSLYERLQGAYREKFKVPFDSI<br>DEDYDAEQEPFRNTLVRHQDRFPYFALRYFDYNEIFKNLRFQI<br>DLGTYHFSIYKKLIGDNKEDRHLTHKLYGFERIQEFAKQKRPN<br>EWQALVKDLDIYETSNEQYISETTPHYHLENQKIGIRFKNKKD<br>KIWPSLETNGKENEKSKYNLDKSFQAEAFLSIHELLPMMFYDL<br>LLKKEEPNNDEKNASIVEGFIKKEIKRMYAIYDAFANEEINSK<br>EGLEEYCKNKGFQERHLPKQMIAILTNKSKNMAEKAKRKQKEM<br>IKDTKKRLATLDKQVKGEIEDGGRNIRLLKSGEIARWLVNDMM<br>RFQSVQKDKEGKPLNNSKANSTEYQMLQRSLALYNKEQKPTPY<br>FIQVNLIKSSNPHPFLEETKWEECNNILSFYRSYLEAKKNFLE<br>SLKPEDWKKNQYFLMLKEPKTNRKTLVQGWKNGFNLPRGIFTE<br>PIKEWFKRHQNDSEEYKKVEALDRVGLVAKVIPLFFKEEYFKE<br>DAQKEINNCVQPFYSFPYNVGNIHKPEEKNFLHCEERRKLWDK<br>KKDKFKGYKAKEKSKKMTDKEKEEHRSYLEFQSWNKFERELRL<br>VRNQDIVTWLLCTELIDKLKIDELNIEELQKLRLKDIDTDTAK<br>KEKNNILNRIMPMQLPVTVYEIDKSFNIVKDKPLHTIYIEETG<br>TKLLKQGNFKALVKDRRLNGLFSFVKTSSEAESKSKPISKLRV<br>EYELGAYQKARIDIIKDMLAEKTLIDNDENLPTNKFSDMLKS<br>WLKGKGEANKARLQNDVDLLVAIRNAFSHNQYPMYNSEVFKGM<br>KLLSLSSDIPEKEGLGIAKQLKDKIKETIERIIEIEKEIRN |
| [Porphyromonas<br>gingivalis<br>(SEQ ID<br>No. 128) | WP_039417390 | MTEQNERPYNGTYYTLEDKHFWAAFFNLARHNAYITLAHIDRQ<br>LAYSKADITNDEDILFFKGQWNLNDLDERKARLRSLILKHFS<br>FLEGAAYGKKLFESQSSGNKSSKKKELTKKEKEELQANALSLD<br>NLKSILFDFLQKLKDFRNYYSHYRHPESSELPLFDGNMLQRLY<br>NVFDVSVQRVKRDHEHNDKVDPHRHFNHLVRKGKKDRYGNNDN<br>PFFKHHFVDREGTVTEAGLLFFVSLFLEKRDAIWMQKKIRGFK<br>GGTEAYQQMTNEVFCRSRISLPKLKLESLRTDDWMLLDMLNEL<br>VRCPKSLYDRLREEDRARFRVPIDILSDEDDTDGTEEDPFKNT<br>LVRHQDRFPYFALRYFDLKKVFTSLRFHIDLGTYHFAIYKKNI<br>GEQPEDRHLTRNLYGFGRIQDFAEEHRPEEWKRLVRDLDYFET<br>GDKPYITQTTPHYHIEKGKIGLRFVPEGQHLWPSPEVGATRTG<br>RSKYAQDKRLTAEAFLSHELMPMMFYYFLLREKYSEEVSAEK<br>VQGRIKRVIEDVYAVYDAFARGEIDTLDRLDACLADKGIRRGH<br>LPRQMIAILSQEHKDMEEKVRKKLQEMIADTDHRLDMLDRQTD<br>RKIRIGRKNAGLPKSGVIADWLVRDMMRFQPVAKDTSGKPLNN<br>SKANSTEYRMLQRALALFGGEKERLTPYFRQMNLTGGNNPHPF<br>LHETRWESHTNILSFYRSYLKARKAFLQSIGRSDREENHRFLL<br>LKEPKTDRQTLVAGWKSEFHLPRGIFTEAVRDCLIEMGYDEVG<br>SYKEVGFMAKAVPLYFERACKDRVQPFYDYPFNVGNSLKPKKG<br>RFLSKEKRAEEWESGKERFRLAKLKKEILEAKEHPYLDFKSWQ<br>KFERELRLVKNQDIITWMMCRDLMEENKVEGLDTGTLYLKDIR<br>TDVHEQGSLNVLNRVKPMRLPVVVYRADSRGHVHKEQAPLATV<br>YIEERDTKLLKQGNFKSFVKDRRLNGLFSFVDTGALAMEQYPI<br>SKLRVEYELAKYQTARVCAFEQTLELEEESLLTRYPHLPDKNFR<br>KMLESWSDPLLDKWPDLHRKVRLLIAVRNAFSHNQYPMYDEAV<br>FSSIRKYDPSSPDAIEERMGLNIAHRLSEEVKQAKEMAERIIQ<br>V |

TABLE 3-continued

| | | |
|---|---|---|
| *Porphyromonas gulae* (SEQ ID No. 129) | WP_039418912 | MTEQSERPYNGTYYTLEDKHFWAAFLNLARHNAYITLTHIDRQ LAYSKADITNDQDVLSFKALWKNLDNDLERKSRLRSLILKHFS FLEGAAYGKKLFESKSSGNKSSKNKELTKKEKEELQANALSLD NLKSILFDFLQKLKDFRNYYSHYRHSGSSELPLFDGNMLQRLY NVFDVSVQRVKRDHEHNDKVDPRHFNHLVRKGKKDRYGHNDN PSFKHHFVDSEGMVTEAGLLFFVSLFLEKRDAIWMQKKIRGFK GGTETYQQMTNEVFCRSRISLPKLKLESLRMDDWMLLDMLNEL VRCPKPLYDRLREDDRACFRVPVDILPDEDDTDGGGEDPFKNT LVRHQDRFPYFALRYFDLKKVFTSLRFHIDLGTYHFAIYKKMI GEQPEDRHLTRNLYGFGRIQDFAEEHRPEEWKRLVRDLDYFET GDKPYISQTSPHYHIEKGKIGLRFMPEGQHLWPSPEVGTTRTG RSKYAQDKRLTAEAFLSVHELMPMMFYYFLLREKYSEEVSAEK VQGRIKRVIEDVYAIYDAFARDEINTLKELDACLADKGIRRGH LPKQMIAILSQEHKNMEEKVRKKLQEMIADTDHRLDMLDRQTD RKIRIGRKNAGLPKSGVIADWLVRDMMRFQPVAKDASGKPLNN SKANSTEYRMLQRALALFGGEKERLTPYFRQMNLTGGNNPHPF LHDTRWESHTNILSFYRSYLRARKAFLERIGRSDRMENRPFLL LKEPKTDRQTLVAGWKSEFHLPRGIFTEAVRDCLIEMGYDEVG SYREVGFMAKAVPLYFERACEDRVQPFYDSPFNVGNSLKPKKG RFLSKEERAEEWERGKERFRDLEAWSHSAARRIEDAFAGIEYA SPGNKKKIEQLLRDLSLWEAFESKLKVRADKINLAKLKKEILE AQEHPYHDFKSWQKFERELRLVKNQDIITWMMCRDLMEENKVE GLDTGTLYLKDIRTNVQEQGSLNVLNHVKPMRLPVVVYRADSR GHVHKEEAPLATVYIEERDTKLLKQGNFKSFVKDRRLNGLFSF VDTGGLAMEQYPISKLRVEYELAKYQTARVCAFEQTLELEESL LTRYPHLPDKNFRKMLESWSDPLLAKWPELHGKVRLLIAVRNA FSHNQYPMYDEAVFSSIRKYDPSSPDAIEERMGLNIAHRLSEE VKQAKETVERIIQA |
| *Porphyromonas gulae* (SEQ ID No. 130) | WP_039419792 | MTEQSERPYNGTYYTLEDKHFWAAFLNLARHNAYITLTHIDRQ LAYSKADITNDQDVLSFKALWKNLDNDLERKSRLRSLILKHFS FLEGAAYGKKLFESKSSGNKSSKNKELTKKEKEELQANALSLD NLKSILFDFLQKLKDFRNYYSHYRHSGSSELPLFDGNMLQRLY NVFDVSVQRVKRDHEHNDKVDPRHFNHLVRKGKKDRYGHNDN PSFKHHFVDGEGMVTEAGLLFFVSLFLEKRDAIWMQKKIRGFK GGTETYQQMTNEVFCRSRISLPKLKLESLRTDDWMLLDMLNEL VRCPKPLYDRLREKDRARFRVPVDILPDEDDTDGGGEDPFKNT LVRHQDRFPYFALRYFDLKKVFTSLRFHIDLGTYHFAIYKKVI GEQPEDRHLTRNLYGFGRIQDFAEEHRPEEWKRLVRDLDYFET GDKPYISQTTPHYHIEKGKIGLRFVPEGQHLWPSPEVGTTRTG RSKYAQDKRLTAEAFLSVHELMPMMFYYFLLREKYSEEVSAEK VQGRIKRVIEDVYAIYDAFARDEINTRDELDACLADKGIRRGH LPKQMIGILSQEHKNMEEKVRKKLQEMIADTDHRLDMLDRQTD RKIRIGRKNAGLPKSGVIADWLVRDMMRFQPVAKDTSGKPLNN SKANSTEYRMLQRALALFGGEKERLTPYFRQMNLTGGNNPHPF LDETRWESHTNILSFYRSYLRARKAFLERIGRSDRVENRPFLL LKEPKTDRQTLVAGWKSEFHLPRGIFTEAVRDCLIEMGYDEVG SYKEVGFMAKAVPLYFERACKDRVQPFYDSPFNVGNSLKPKKG RFLSKEKRAEEWESGKERFRLAKLKKEILEAQEHPYHDFKSWQ KFERELRLVKNQDIITWMMCRDLMEENKVEGLDTGTLYLKDIR PNVQEQGSLNVLNRVKPMRLPVVVYRADSRGHVHKEEAPLATV YIEERDTKLLKQGNFKSFVKDRRLNGLFSFVDTGGLAMEQYPI SKLRVEYELAKYQTARVCVFELTLRLEESLLSRYPHLPDESFR EMLESWSDPLLAKWPELHGKVRLLIAVRNAFSHNQYPMYDEAV FSSIRKYDPSSPDAIEERMGLNIAHRLSEEVKQAKETVERIIQ A |
| *Porphyromonas gulae* (SEQ ID No. 131) | WP_039426176 | MTEQSERPYNGTYYTLEDKHFWAAFLNLARHNAYITLTHIDRQ LAYSKADITNDQDVLSFKALWKNFDNDLERKSRLRSLILKHFS FLEGAAYGKKLFESKSSGNKSSKNKELTKKEKEELQANALSLD NLKSILFDFLQKLKDFRNYYSHYRHSGSSELPLFDGNMLQRLY NVFDVSVQRVKRDHEHNDKVDPHYHFNHLVRKGKKDRYGHNDN PSFKHHFVDSEGMVTEAGLLFFVSLFLEKRDAIWMQKKIRGFK GGTGPYEQMTNEVFCRSRISLPKLKLESLRTDDWMLLDMLNEL VRCPKPLYDRLREKDRACFRVPVDILPDEDDTDGGGEDPFKNT LVRHQDRFPYFALRYFDLKKVFTSLRFHIDLGTYHFAIYKKMI GEQPEDRHLTRNLYGFGRIQDFAEEHRPEEWKRLVRDLDYFET GDKPYISQTTPHYHIEKGKIGLRFMPEGQHLWPSPEVGTTRTG RSKYAQDKRLTAEAFLSVHELMPMMFYYFLLREKYSEEVSAEK VQGRIKRVIKDVYAIYDAFARDEINTLKELDACSADKGIRRGH LPKQMIGILSQEHKNMEEKVRKKLQEMIADTDHRLDMLDRQTD RKIRIGRKNAGLPKSGVIADWLVRDMMRFQPVAKDTSGKPLNN SKANSTEYRMLQRALALFGGEKERLTPYFRQMNLTGGNNPHPF LDETRWESHTNILSFYRSYLRARKAFLERIGRSDRVENRPFLL LKEPKNDRQTLVAGWKSEFHLPRGIFTEAVRDCLIEMGYDEVG SYKEVGFMAKAVPLYFERACKDRVQPFYDSPFNVGNSLKPKKG RFLSKEKRAEEWESGKERFRLAKLKKEILEAKEHPYHDFKSWQ KFERELRLVKNQDIITWMMCRDLMEENKVEGLDTGTLYLKDIR TDVHEQGSLNVLNRVKPMRLPVVVYRADSRGHVHKEQAPLATV YIEERDTKLLKQGNFKSFVKDRRLNGLFSFVDTGGLAMEQYPI |

TABLE 3-continued

| | | |
|---|---|---|
| | | SKLRVEYELAKYQTARVCAFEQTLELEESLLTRYPHLPDENFR EMLESWSDPLLGKWPDLHGKVRLLIAVRNAFSHNQYPMYDEAV FSSIRKYDPSSPDAIEERMGLNIAHRLSEEVKQAKETVERIIQ A |
| Porphyromonas gulae (SEQ ID No. 132) | WP_039431778 | MTEQSERPYNGTYYTLEDKHFWAAFLNLARHNAYITLTHIDRQ LAYSKADITNDQDVLSFKALWKNFDNDLERKSRLRSLILKHFS FLEGAAYGKKLFESKSSGNKSSKNKELTKKEKEELQANALSLD NLKSILFDFLQKLKDFRNYYSHYRHSESSELPLFDGNMLQRLY NVFDVSVQRVKRDHEHNDKVDPHRHFNHLVRKGKKDRYGHNDN PSFKHHFVDGEGMVTEAGLLFFVSLFLEKRDAIWMQKKIRGFK GGTETYQQMTNEVFCRSRISLPKLKLESLRTDDWMLLDMLNEL VRCPKPLYDRLREDDRACFRVPVDILPDEDDTDGGGEDPFKNT LVRHQDRFPYFALRYFDLKKVFTSLRFHIDLGTYHFAIYKKMI GEQPEDRHLTRNLYGFGRIQDFAEEHRPEEWKRLVRDLDYFET GDKPYISQTSPHYHIEKGKIGLRFMPEGQHLWPSPEVGTTRTG RSKYAQDKRLTAEAFLSVHELMPMMFYYFLLREKYSEEVSAEK VQGRIKRVIEDVYAIYDAFARDEINTLKELDACLADKGIRRGH LPKQMIAILSQEHKDMEEKIRKKLQEMIADTDHRLDMLDRQTD RKIRIGRKNAGLPKSGVIADWLVRDMMRFQPVAKDTSGKPLNN SKANSTEYRMLQRALALFGGEKKRLTPYFRQMNLTGGNNPHPF LHETRWESHTNILSFYRSYLRARKAFLERIGRSDRMENRPFLL LKEPKTDRQTLVAGWKSEFHLPRGIFTEAVRDCLIEMGYDEVG SYREVGFMAKAVPLYFERACEDRVQPFYDSPFNVGNSLKPKKG RFLSKEERAEEWERGKERFRDLEAWSHSAARRIEDAFAGIEYA SPGNKKKIEQLLRDLSLWEAFESKLKVRADKINLAKLKKEILE AQEHPYHDFKSWQKFERELRLVKNQDIITWMMCRDLMEENKVE GLDTGTLYLKDIRPNVQEQGSLNVLNRVKPMRLPVVVYRADSR GHVHKEEAPLATVYIEERDTKLLKQGNFKSFVKDRRLNGLFSF VDTGGLAMEQYPISKLRVEYELAKYQTARVCVFELTLRLEESL LTRYPHLPDESFRKMLESWSDPLLAKWPELHGKVRLLIAVRNA FSHNQYPMYDEAVFSSIRKYDPSSPDAIEERMGLNIAHRLSEE VKQAKETVERIIQV |
| Porphyromonas gulae (SEQ ID No. 133) | WP_039437199 | MTEQSERPYNGTYYTLEDKHFWAAFLNLARHNAYITLTHIDRQ LAYSKADITNDEDILFFKGQWKNLDNDLERKSRLRSLILKHFS FLEGAAYGKKFFESKSSGNKSSKNKELTKKEKEELQANALSLD NLKSILFDFLQKLKDFRNYYSHYRHSGSSELPLFDGNMLQRLY NVFDVSVQRVKRDHEHNDEVDPHYHFNHLVRKGKKDRYGHNDN PSFKHHFVDGEGMVTEAGLLFFVSLFLEKRDAIWMQKKIRGFK GGTEPYEQMTNEVFCRSRISLPKLKLESLRTDDWMLLDMLNEL VRCPKPLYDRLREKDRACFRVPVDILPDEDDTDGGGEDPFKNT LVRHQDRFPYFALRYFDLKKVFTSLRFHIDLGTYHFAIYKKMI GEQPEDRHLTRNLYGFGRIQDFAEEHRPEEWKRLVRDLDYFET GDKPYISQTTPHYHIEKGKIGLRFVPEGQHLWPSPEVGTTRTG RSKYAQDKRLTAEAFLSVHELMPMMFYYFLLREKYSEEVSAEK VQGRIKRVIEDVYAIYDAFARDEINTLKELDACLADKGIRRGH LPKQMIGILSQERKDMEEKVRKKLQEMIADTDHRLDMLDRQTD RKIRIGRKNAGLPKSGVIADWLVRDMMRFQPVAKDTSGKPLNN SKANSTEYRMLQRALALFGGEKERLTPYFRQMNLTGGNNPHPF LHETRWESHTNILSFYRSYLRARKAFLERIGRSDRVENCPFLL LKEPKTDRQTLVAGWKGEFHLPRGIFTEAVRDCLIEMGYDEVG SYREVGFMAKAVPLYFERACEDRVQPFYDSPFNVGNSLKPKKG RFLSKEKRAEEWESGKERFRLAKLKKEILEAQEHPYHDFKSWQ KFERELRLVKNQDIITWMMCRDLMEENKVEGLDTGTLYLKDIR PNVQEQGSLNVLNRVKPMRLPVVVYRADSRGHVHKEEAPLATV YIEERDTKLLKQGNFKSFVKDRRLNGLFSFVDTGALAMEQYPI SKLRVEYELAKYQTARVCAFEQTLELEESLLTRYPHLPDESFR EMLESWSDPLLTKWPELHGKVRLLIAVRNAFSHNQYPMYDEAV FSSIWKYDPSSPDAIEERMGLNIAHRLSEEVKQAKETIERIIQ A |
| Porphyromonas gulae (SEQ ID No. 134) | WP_039442171 | MTEQSERPYNGTYYTLEDKHFWAAFLNLARHNAYITLTHIDRQ LAYSKADITNDQDVLSFKALWKNLDNDLERKSRLRSLILKHFS FLEGAAYGKKLFESKSSGNKSSKNKELTKKEKEELQANALSLD NLKSILFDFLQKLKDFRNYYSHYRHSGSSELPLFDGNMLQRLY NVFDVSVQRVKRDHEHNDKVDPHYHFNHLVRKGKKDRYGHNDN PSFKHHFVDSEGMVTEAGLLFFVSLFLEKRDAIWMQKKIRGFK GGTGPYEQMTNEVFCRSRISLPKLKLESLRTDDWMLLDMLNEL VRCPKPLYDRLREKDRACFRVPVDILPDEDDTDGGGEDPFKNT LVRHQDRFPYFALRYFDLKKVFTSLRFHIDLGTYHFAIYKKMI GEQPEDRHLTRNLYGFGRIQDFAEEHRPEEWKRLVRDLDYLET GDKPYISQTTPHYHIEKGKIGLRFVPEGQHLWPSPEVGTTRTG RSKCAQDKRLTAEAFLSVHELMPMMFYYFLLREKYSEEVSAEK VQGRIKRVIEDVYAIYDAFARDEINTLKELDTCLADKGIRRGH LPKQMITILSQERKDMKEKIRKKLQEMIADTDHRLDMLDRQTD RKIRIGRKNAGLPKSGVIADWLVRDMMRFQPVAKDASGKPLNN SKANSTEYRMLQRALALFGGEKERLTPYFRQMNLTGGNNPHPF LHETRWESHTNILSFYRSYLRARKAFLERIGRSDRVENCPFLL LKEPKTDRQTLVAGWKDEFHLPRGIFTEAVRDCLIEMGYDEVG |

TABLE 3-continued

| | | |
|---|---|---|
| | | SYREVGFMAKAVPLYFERACEDRVQPFYDSPFNVGNSLKPKKG<br>RFLSKEDRAEEWERGMERFRDLEAWSHSAARRIKDAFAGIEYA<br>SPGNKKKIEQLLRDLSLWEAFESKLKVRADKINLAKLKKEILE<br>AQEHPYHDFKSWQKFERELRLVKNQDIITWMMCRDLMEENKVE<br>GLDTGTLYLKDIRPNVQEQGSLNVLNRVKPMRLPVVVYRADSR<br>GHVHKEAPLATVYIEERNTKLLKQGNFKSFVKDRRLNGLFSFV<br>DTGGLAMEQYPISKLRVEYELAKYQTARVCVFELTRLEESLL<br>SRYPHLPDESFREMLESWSDPLLAKWPELHGKVRLLIAVRNAF<br>SHNQYPMYDEAVFSSIRKYDPSSPDAIEERMGLNIAHRLSEEV<br>KQAKETVERIIQA |
| Porphyromonas<br>gulae<br>(SEQ ID<br>No. 135) | WP_039445055 | MNTVPATENKGQSRTVEDDPQYFGLYLNLARENLIEVESHVRI<br>KFGKKKLNEESLKQSLLCDHLLSIDRWTKVYGHSRRYLPFLHC<br>FDPDSGIEKDHDSKTGVDPDSAQRLIRELYSLLDFLRNDFSHN<br>RLDGTTFEHLKVSPDISSFITGAYTFACERAQSRFADFFKPDD<br>FLLAKNRKEQLISVADGKECLTSGFAFFICLFLDREQASGML<br>SRIRGFKRTDENWARAVHETFCDLCIRHPHDRLESSNTKEALL<br>LDMLNELNRCPRILYDMLPEEERAQFLPALDENSMNNLSENSL<br>NEESRLLWDGSSDWAEALTKRIRHQDRFPYLMLRFIEEMDLLK<br>GIRFRVDLGEIELDSYSKKVGRNGEYDRTITDHALAFGKLSDF<br>QNEEEVSRMISGEASYPVRFSLFAPRYAIYDNKIGYCHTSDPV<br>YPKSKTGEKRALSNPQSMGFISVHDLRKLLLMELLCEGSFSRM<br>QSDFLRKANRILDETAEGKLQFSALFPEMRHRFIPPQNPKSKD<br>RREKAETTLEKYKQEIKGRKDKLNSQLLSAFDMNQRQLPSRLL<br>DEWMNIRPASHSVKLRTYVKQLNEDCRLRLRKFRKDGDGKARA<br>IPLVGEMATFLSQDIVRMIISEETKKLITSAYYNEMQRSLAQY<br>AGEENRRQFRAIVAELHLLDPSSGHPFLSATMETAHRYTEDFY<br>KCYLEKKREWLAKTFYRPEQDENTKRRISVFFVPDGEARKLLP<br>LLIRRRMKEQNDLQDWIRNKQAHPIDLPSHLFDSKIMELLKVK<br>DGKKKWNEAFKDWWSTKYPDGMQPFYGLRRELNIHGKSVSYIP<br>SDGKKFADCYTHLMEKTVRDKKRELRTAGKPVPPDLAAYIKRS<br>FHRAVNEREFMLRLVQEDDRLMLMAINKMMTDREEDILPGLKN<br>IDSILDEENQFSLAVHAKVLEKEGEGGDNSLSLVPATIEIKSK<br>RKDWSKYIRYRYDRRVPGLMSHFPEHKATLDEVKTLLGEYDRC<br>RIKIFDWAFALEGAIMSDRDLKPYLHESSSREGKSGEHSTLVK<br>MLVEKKGCLTPDESQYLILIRNKAAHNQFPCAAEMPLIYRDVS<br>AKVGSIEGSSAKDLPEGSSLVDSLWKKYEMIIRKILPILDHEN<br>RFFGKLLNNMSQPINDL |
| Capnocytophaga<br>cynodegmi<br>(SEQ ID<br>No. 136) | WP_041989581 | MENKTSLGNNIYYNPFKPQDKSYFAGYLNAAMENIDSVFRELG<br>KRLKGKEYTSENFFDAIFKENISLVEYERYVKLLSDYFPMARL<br>LDKKEVPIKERKENFKKNFRGIIKAVRDLRNFYTHKEHGEVEI<br>TDEIFGVLDEMLKSTVLTVKKKKIKTDKTKEILKKSIEKQLDI<br>LCQKKLEYLKDTARKIEEKRRNQRERGEKKLVPRFEYSDRRDD<br>LIAAIYNDAFDVYIDKKKDSLKESSKTKYNTESYPQQEEGDLK<br>IPISKNGVVFLLSLFLSKQEVHAFKSKIAGFKATVIDEATVSH<br>RKNSICFMATHEIFSHLAYKKLRKVRTAEINYSEAENAEQLS<br>IYAKETLMMQMLDELSKVPDVVYQNLSEDVQKTFIEDWNEYLK<br>ENNGDVGTMEEEQVIHPVIRKRYEDKFNYFAIRFLDEFAQFPT<br>LRFQVHLGNYLHDSRPKEHLISDRRIKEKITVFGRLSELEHKK<br>ALFIKNTETNEDRKHYWEVFPNPNYDFPKENISVNDKDFPIAG<br>SILDREKQPTAGKIGIKVNLLNQKYISEVDKAVKAHQLKQRNN<br>KPSIQNIIEEIVPINGSNPKEIIVFGGQPTAYLSMNDIHSILY<br>EFFDKWEKKKEKLEKKGEKELRKEIGKELEEKIVGKIQTQIQQ<br>IIDKDINAKILKPYQDDDSTAIDKEKLIKDLKQEQKILQKLKN<br>EQTAREKEYQECIAYQEESRKIKRSDKSRQKYLRNQLKRKYPE<br>VPTRKEILYYQEKGKVAVWLANDIKRFMPTDFKNEWKGEQHSL<br>LQKSLAYYEQCKEELKNLLPQQKVFKHLPFELGGHFQQKYLYQ<br>FYTRYLDKRLEHISGLVQQAENFKNENKVFKKVENECFKFLKK<br>QNYTHKGLDAQAQSVLGYPIFLERGFMDEKPTIIKGKTFKGNE<br>SLFTDWFRYYKEYQNFQTFYDTENYPLVELEKKQADRKRETKI<br>YQQKKNDVFTLLMAKHIFKSVFKQDSIDRFSLEDLYQSREERL<br>ENQEKAKQTGERNTNYIWNKTVDLNLCDGKVTVENVKLKNVGN<br>FIKYEYDQRVQTFLKYEENIKWQAFLIKESKEEENYPYIVERE<br>IEQYEKVRREELLKEVHLIEEYILEKVKDKEILKKGDNQNFKY<br>YILNGLLKQLKNEDVESYKVFNLNTKPEDVNINQLKQEATDLE<br>QKAFVLTYIRNKFAHNQLPKKEFWDYCQEKYGKIEKEKTYAEY<br>FAEVFKREKEALMK |
| Prevotella<br>sp. P5-119<br>(SEQ ID<br>No. 137) | WP_042518169 | MNIPALVENQKKYFGTYSVMAMLNAQTVLDHIQKVADIEGEQN<br>ENNENLWFHPVMSHLYNAKNGYDKQPEKTMFIIERLQSYFPFL<br>KIMAENQREYSNGKYKQNRVEVNSNDIFEVLKRAFGVLKMYRD<br>LTNHYKTYEEKLIDGCEFLTSTEQPLSGMISKYYTVALRNTKE<br>RYGYKTEDLAFIQDNIKKITKDAYGKRKSQVNTGFFLSLQDYN<br>GDTQKKLHLSGVGIALLICLFLDKQYINIFLSRLPIFSSYNAQ<br>SEERRIIIRSFGINSIKLPKDRIHSEKSNKSVAMDMLNEVKRC<br>PDELFTTLSAEKQSRFRIISDDHNEVLMKRSTDRFVPLLLQYI<br>DYGKLFDHIRFHVNMGKLRYLLKADKTCIDGQTRVRVIEQPLN<br>GFGRLEEAETMRKQENGTFGNSGIRIRDFENVKRDDANPANYP<br>YIVDTYTHYILENNKVEMFISDKGSSAPLLPLIEDDRYVVKTI |

TABLE 3-continued

| | | |
|---|---|---|
| | | PSCRMSTLEIPAMAFHMFLFGSKKTEKLIVDVHNRYKRLFQAM
QKEEVTAENIASFGIAESDLPQKILDLISGNAHGKDVDAFIRL
TVDDMLTDTERRIKRFKDDRKSIRSADNKMGKRGFKQISTGKL
ADFLAKDIVLFQPSVNDGENKITGLNYRIMQSAIAVYDSGDDY
EAKQQFKLMFEKARLIGKGTTEPHPFLYKVFARSIPANAVDFY
ERYLIERKFYLTGLCNEIKRGNRVDVPFIRRDQNKWKTPAMKT
LGRIYSEDLPVELPRQMFDNEIKSHLKSLPQMEGIDFNNANVT
YLIAEYMKRVLNDDFQTFYQWKRNYHYMDMLKGEYDRKGSLQH
CFTSVEEREGLWKERASRTERYRKLASNKIRSNRQMRNASSEE
IETILDKRLSNCRNEYQKSEKVIRRYRVQDALLFLLAKKTLTE
LADFDGERFKLKEIMPDAEKGILSEIMPMSFTFEKGGKKYTIT
SEGMKLKNYGDFFVLASDKRIGNLLELVGSDIVSKEDIMEEFN
KYDQCRPEISSIVFNLEKWAFDTYPELSARVDREEKVDFKSIL
KILLNNKNINKEQSDILRKIRNAFDHNNYPDKGIVEIKALPEI
AMSIKKAFGEYAIMK |
| Prevotella
sp. P4-76
(SEQ ID
No. 138) | WP_044072147 | MNIPALVENQKKYFGTYSVMAMLNAQTVLDHIQKVADIEGEQN
ENNENLWFHPVMSHLYNAKNGYDKQPEKTMFIIERLQSYFPFL
KIMAENQREYSNGKYKQNRVEVNSNDIFEVLKRAFGVLKMYRD
QASHYKTYDEKLIDGCEFLTSTEQPLSGMINNYYTVALRNMNE
RYGYKTEDLAFIQDKRFKFVKDAYGKKKSQVNTGFFLSLQDYN
GDTQKKLHLSGVGIALLICLFLDKQYINIFLSRLPIFSSYNAQ
SEERRIIRSFGINSIKQPKDRIHSEKSNKSVAMDMLNEIKRC
PNELFETLSAEKQSRFRIISNDHNEVLMKRSSDRFVPLLLQYI
DYGKLFDHIRFHVNMGKLRYLLKADKTCIDGQTRVRVIEQPLN
GFGRLEEVETMRKQENGTFGNSGIRIRDFENMKRDDANPANYP
YIVDTYTHYILENNKVEMFISDEETPAPLLPVIEDDRYVVKTI
PSCRMSTLEIPAMAFHMFLFGSKKTEKLIVDVHNRYKRLFKAM
QKEEVTAENIASFGIAESDLPQKIIDLISGNAHGKDVDAFIRL
TVDDMLADTERRIKRFKDDRKSIRSADNKMGKRGFKQISTGKL
ADFLAKDIVLFQPSVNDGENKITGLNYRIMQSAIAVYNSGDDY
EAKQQFKLMFEKARLIGKGTTEPHPFLYKVFVRSIPANAVDFY
ERYLIERKFYLIGLSNEIKKGNRVDVPFIRRDQNKWKTPAMKT
LGRIYDEDLPVELPRQMFDNEIKSHLKSLPQMEGIDFNNANVT
YLIAEYMKRVLNDDFQTFYQWKRNYRYMDMLRGEYDRKGSLQS
CFTSVEEREGLWKERASRTERYRKLASNKIRSNRQMRNASSEE
IETILDKRLSNRNEYQKSEKVIRRYRVQDALLFLLAKKTLTE
LADFDGERFKLKEIMPDAEKGILSEIMPMSFTFEKGGKKYTIT
SEGMKLKNYGDFFVLASDKRIGNLLELVGSDTVSKEDIMEEFK
KYDQCRPEISSIVFNLEKWAFDTYPELSARVDREEKVDFKSIL
KILLNNKNINKEQSDILRKIRNAFDHNNYPDKGVVEIRALPEI
AMSIKKAFGEYAIMK |
| Prevotella
sp. P5-60
(SEQ ID
No. 139) | WP_044074780 | MNIPALVENQKKYFGTYSVMAMLNAQTVLDHIQKVADIEGEQN
ENNENLWFHPVMSHLYNAKNGYDKQPEKTMFIIERLQSYFPFL
KIMAENQREYSNGKYKQNRVEVNSNDIFEVLKRAFGVLKMYRD
LTNHYKTYEEKLIDGCEFLTSTEQPFSGMISKYYTVALRNTKE
RYGYKAEDLAFIQDNRYKFTDAYGKRKSQVNTGSFLSLQDYN
GDTTKKLHLSGVGIALLICLFLDKQYINLFLSRLPIFSSYNAQ
SEERRIIRSFGINSIKQPKDRIHSEKSNKSVAMDMLNEVKRC
PDELFTTLSAEKQSRFRIISDDHNEVLMKRSSDRFVPLLLQYI
DYGKLFDHIRFHVNMGKLRYLLKADKTCIDGQTRVRVIEQPLN
GFGRLEEVETMRKQENGTFGNSGIRIRDFENMKRDDANPANYP
YIVETYTHYILENNKVEMFISDEENPTPLLPVIEDDRYVVKTI
PSCRMSTLEIPAMAFHMFLFGSEKTEKLIIDVHDRYKRLFQAM
QKEEVTAENIASFGIAESDLPQKIMDLISGNAHGKDVDAFIRL
TVDDMLTDTERRIKRFKDDRKSIRSADNKMGKRGFKQISTGKL
ADFLAKDIVLFQPSVNDGENKITGLNYRIMQSAIAVYDSGDDY
EAKQQFKLMFEKARLIGKGTTEPHPFLYKVFVRSIPANAVDFY
ERYLIERKFYLIGLSNEIKKGNRVDVPFIRRDQNKWKTPAMKT
LGRIYSEDLPVELPRQMFDNEIKSHLKSLPQMEGIDFNNANVT
YLIAEYMKRVLNDDFQTFYQWKRNYRYMDMLRGEYDRKGSLQH
CFTSIEEREGLWKERASRTERYRKLASNKIRSNRQMRNASSEE
IETILDKRLSNCRNEYQKSEKIIRRYRVQDALLFLLAKKTLTE
LADFDGERFKLKEIMPDAEKGILSEIMPMSFTFEKGGKIYTIT
SGGMKLKNYGDFFVLASDKRIGNLLELVGSNTVSKEDIMEEFK
KYDQCRPEISSIVFNLEKWAFDTYPELPARVDREKVDFWSIL
DVLSNNKDINNEQSYILRKIRNAFDHNNYPDKGIVEIKALPEI
AMSIKKAFGEYAIMK |
| Phaeodactylibacter
xiamenensis
(SEQ ID
No. 140) | WP_044218239 | MTNTPKRRTLHRHPSYFGAFLNIARHNAFMIMEHLSTKYDMED
KNTLDEAQLPNAKLFGCLKKRYGKPDVTEGVSRDLRRYFPFLN
YPFLFLHLEKQQNAEQAATYDINPEDIEFTLKGFFRLLNQMRNN
YSHYISNTDYGKFDKLPVQDIYEAAIFRLLDRGKHTKRFDVFE
SKHTRHLESNNSEYRPRSLANSPDHENTVAFVTCLFLERKYAF
PFLSRLDCFRSTNDAAEGDPLIRKASHECYTMFCCRLPQPKLE
SSDILLDMVNELGRCPSALYNLLSEEDQARFHIKREEITGFEE
DPDEELEQEIVLKRHSDRFPYFALRYFDDTEAFQTLRFDVYLG
RWRTKPVYKKRIYGQERDRVLTQSIRTFTRLSRLLPIYENVKH
DAVRQNEEDGKLVNPDVTSQFHKSWIQIESDDRAFLSDRIEHF |

TABLE 3-continued

| | | |
|---|---|---|
| | | SPHYNFGDQVIGLKFINPDRYAAIQNVFPKLPGEEKKDKDAKL
VNETADAIISTHEIRSLFLYHYLSKKPISAGDERRFIQVDTET
FIKQYIDTIKLFFEDIKSGELQPIADPPNYQKNEPLPYVRGDK
EKTQEERAQYRERQKEIKERRKELNTLLQNRYGLSIQYIPSRL
REYLLGYKKVPYEKLALQKLRAQRKEVKKRIKDIEKMRTPRVG
EQATWLAEDIVFLTPPKMHTPERKTTKHPQKLNNDQFRIMQSS
LAYFSVNKKAIKKFFQKETGIGLSNRETSHPFLYRIDVGRCRG
ILDPFYTGYLKYKMDWLDDAIKKVDNRKHGKKEAKKYEKYLPSS
IQHKTPLELDYTRLPVYLPRGLFKKAIVKALAAHADFQVEPEE
DNVIFCLDQLLDGDTQDFYNWQRYYRSALTEKETDNQLVLAHP
YAEQILGTIKTLEGKQKNNKLGNKAKQKIKDELIDLKRAKRRL
LDREQYLRAVQAEDRALWLMIQERQKQKAEHEEIAFDQLDLKN
ITKILTESIDARLRIPDTKVDITDKLPLRRYGDLRRVAKDRRL
VNLASYYHVAGLSEIPYDLVKKELEEYDRRRVAFFEHVYQFEK
EVYDRYAAELRNENPKGESTYFSHWEYVAVAVKHSADTHFNEL
FKEKVMQLRNKFHHNEFPYFDWLLPEVEKASAALYADRVFDVA
EGYYQKMRKLMRQ |
| Flavobacterium
sp.
(SEQ ID
No. 141) | WP_045968373167 | MDNNITVEKTELGLGITYNHDKVEDKHYFGGFFNLAQNNIDLV
AQEFKKRLLIQGKDSINIFANYFSDQCSITNLERGIKILAEYF
PVVSYIDLDEKNKSKSIREHLILLLETINNLRNYYTHYYHKKI
IIDGSLFPLLDTILLKVVLEIKKKKLKEDKTKQLLKKGLEKEM
TILFNLMKAEQKEKKIKGWNIDENIKGAVLNRAFSHLLYNDEL
SDYRKSKYNTEDETLKDTLTESGILFLLSFFLNKKEQEQLKAN
IKGYKGKIASIPDEEITLKNNSLRNMATHWTYSHLTYKGLKHR
IKTDHEKETLLVNMVDYLSKVPHEIYQNLSEQNKSLFLEDINE
YMRDNEENHDSSEASRVIHPVIRKRYENKFAYFAIRFLDEFAE
FPTLRFMVNVGNYIHDNRKKDIGGTSLITNRTIKQQINVFGNL
TEIHKKKNDYFEKEENKEKTLEWELFPNPSYHFQKENIPIFID
LEKSKETNDLAKEYAKEKKKIFGSSRKKQQNTAKKNRETIINL
VFDKYKTSDRKTVTFEQPTALLSFNELNSFLYAFLVENKTGKE
LEKIIIEKIANQYQILKNCSSTVDKTNDNIPKSIKKIVNTTTD
SFYFEGKKIDIEKLEKDITIEIEKTNEKLETIKENEESAQNYK
RNERNTQKRKLYRKYVFFTNEIGIEATWITNDILRFLDNKENW
KGYQHSELQKFISQYDNYKKEALGLLESEWNLESDAFFGQNLK
RMFQSNSTFETFYKKYLDNRKNTLETYLSAIENLKTMTDVRPK
VLKKKWTELFRFFDKKIYLLSTIETKINELITKPINLSRGIFE
EKPTFINGKNPNKENNQHLFANWFIYAKKQTILQDFYNLPLEQ
PKAITNLKKHKYKLERSINNLKIEDIYIKQMVDFLYQKLFEQS
FIGSLQDLYTSKEKREIEKGKAKNEQTPDESFIWKKQVEINTH
NGRIIAKTKIKDIGKFKNLLTDNKIAHLISYDDRIWDFSLNND
GDITKKLYSINTELESYETIRREKLLKQIQQFEQFLLEQETEY
SAERKHPEKFEKDCNPNFKKYIIEGVLNKIIPNHEIEEIEILK
SKEDVFKINFSDILILNNDNIKKGYLLIMIRNKFAHNQLIDKN
LFNFSLQLYSKNENENFSEYLNKVCQNIIQEFKEKLK |
| Porphyromonas
gulae
(SEQ ID
No. 142) | WP_046201018 | MTEQSERPYNGTYYTLEDKHFWAAFLNLARHNAYITLTHIDRQ
LAYSKADITNDQDVLSFKALWKNFDNDLERKSRLRSLILKHFS
FLEGAAYGKKLFESKSSGNKSSKNKELTKKEKEELQANALSLD
NLKSILFDFLQKLKDFRNYYSHYRHSESSELPLFDGNMLQRLY
NVFDVSVQRVKRDHEHNDKVDPHRHFNHLVRKGKKDRYGHNDN
PSFKHHFVDSEGMVTEAGLLFFVSLFLEKRDAIWMQKKIRGFK
GGTETYQQMTNEVFCRSRISLPKLKLESLRTDDWMLLDMLNEL
VRCPKPLYDRLREKDRARFRVPVDILPDEDDTDGGGEDPFKNT
LVRHQDRFPYFALRYFDLKKVFTSLRFHIDLGTYHFAIYKKMI
GEQPEDRHLTRNLYGFGRIQDFAEEHRPEEWKRLVRDLDYFET
GDKPYISQTTPHYHIEKGKIGLRFMPEGQHLWPSPEVGTTRTG
RSKYAQDKRLTAEAFLSVHELMPMMFYYFLLREKYSEEVSAEK
VQGRIKRVIEDVYAIYDAFARDEINTLKELDACLADKGIRRGH
LPKQMIAILSQEHKDMEEKIRKKLQEMIADTDHRLDMLDRQTD
RKIRIGRKNAGLPKSGVIADWLVRDMMRFQPVAKDTSGKPLNN
SKANSTEYRMLQRALALFGGEKKRLTPYFRQMNLTGGNNPHPF
LHETRWESHTNILSFYRSYLRARKAFLERIGRSDRMENRPFLL
LKEPKTDRQTLVAGWKSEPHLPRGIFTEAVRDCLIEMGYDEVG
SYREVGFMAKAVPLYFERACEDRVQPFYDSPFNVGNSLKPKKG
RFLSKEERAEEWERGKERFRDLEAWSHSAARRIEDAFAGIEYA
SPGNKKKIEQLLRDLSLWEAFESKLKVRADKINLAKLKKEILE
AQEHPYHDFKSWQKFERELRLVKNQDIITWMMCRDLMEENKVE
GLDTGTLYLKDIRPNVQEQGSLNVLNRVKPMRLPVVVYRADSR
GHVHKEEAPLATVYIEERDTKLLKQGNFKSFVKDRRLNGLFSF
VDTGGLAMEQYPISKLRVEYELAKYQTARVCVFELTLRLEESL
LTRYPHLPDESFRKMLESWSDPLLAKWPELHGKVRLLIAVRNA
FSHNQYPMYDEAVFSSIRKYDPSSPDAIEERMGLNIAHRLSEE
VKQAKETVERIIQV |
| WP_047431796
(SEQ
ID No.
143) | Chryseo-
bacterium sp.
YR477 | METQTIGHGIAYDHSKIQDKHFFGGFLNLAENNIKAVLKAFSE
KFNVGNVDVKQFADVSLKDNLPDNDFQKRVSFLKMYFPVVDFI
NIPNNRAKFRSDLTTLFKSVDQLRNFYTHYYHKPLDFDASLFI
LLDDIFARTAKEVRDQKMKDDKTRQLLSKSLSEELQKGYELQL
ERLKELNRLGKKVNIHDQLGIKNGVLNNAFNHLIYKDGESFKT |

TABLE 3-continued

| | | |
|---|---|---|
| | | KLTYSSALTSFESAENGIEISQSGLLFLLSMFLKRKEIEDLKN RNKGFKAKVVIDEDGKVNGLKFMATHWVFSYLCFKGLKSKLST EFHEETLLIQIIDELSKVPDELYCAFDKETRDKFIEDINEYVK EGHQDFSLEDAKVIHPVIRKRYENKFNYFAIRFLDEFVKFPSL RFQVHVGNYVHDRRIKNIDGTTFETERVVKDRIKVFGRLSETS SYKAQYLSSVSDKHDETGWEIFPNPSYVFINNNIPIHISVDTS FKKEIADFKKLRRAQVPDELKIRGAEKKRKFEITQMIGSKSVL NQEEPIALLSLNEIPALLYEILINGKEPAEIERIIKDKLNERQ DVIKNYNPENWLPASQISRRLRSNKGERIINTDKLLQLVTKEL LVTEQKLKIISDNREALKQKKEGKYIRKFIFTNSELGREAIWL ADDIKRFMPADVRKEWKGYQHSQLQQSLAFYNSRPKEALAILE SSWNLKDEKIIWNEWILKSFTQNKFFDAFYNEYLKGRKKYFAF LSEHIVQYTSNAKNLQKFIKQQMPKDLFEKRHYIIEDLQTEKN KILSKPFIFPRGIFDKKPTFIKGVKVEDSPESFANWYQYGYQK DHQFQKFYDWKRDYSDVFLEHLGKPFINNGDRRTLGMEELKER IIIKQDLKIKKIKIQDLFLRLIAENLFQKVFKYSAKLPLSDFY LTQEERMEKENMAALQNVREEGDKSPNIIKDNFIWSKMIPYKK GQIIENAVKLKDIGKLNVLSLDDKVQTLLSYDDAKPWSKIALE NEFSIGENSYEVIRREKLFKEIQQFESEILFRSGWDGINHPAQ LEDNRRPKFKMYIVNGILRKSAGLYSQGEDIWFEYNADFNNLD ADVLETKSELVQLAFLVTAIRNKFAHNQLPAKEFYFYIRAKYG FADEPSVALVYLNFTKYAINEFKKVMI |
| *Riemerella anatipestifer* (SEQ ID No. 144) | WP_049354263 | MFFSFHNAQRVIFKHLYKAFDASLRMVKEDYKAHFTVNLTRDF AHLNRNKGNKQDNPDFNRYRFEKDGFFTESGLLFFTNLFLDKR DAYWMLKKVSGFKASHKQREKMTTEVFCRSRILLPKLRLESRY DHNQMLLDMLSELSRCPKLLYEKLSEENKKHFQVEADGFLDEI EEEQNPFKDTLIRHQDRFPYFALRYLDLNESFKSIRFQVDLGT YHYCIYDKKIGDEQEKRHLTRTLLSFGRLQDFTEINRPQEWKA LTKDLDYKETSNQPFISKTTPHYHITDNKIGFRLGTSKELYPS LEIKDGANRIAKYPYNSGFVAHAFISVHELLPLMFYQHLTGKS EDLLKETVRHIQRIYKDFEEERINTIEDLEKANQGRLPLGAFP KQMLGLLQNKQPDLSEKAKIKIEKLIAETKLLSHRLNTKLKSS PKLGKRREKLIKTGVLADWLVKDFMRFQPVAYDAQNQPIKSSK ANSTEFWFIRRALALYGGEKNRLEGYFKQTNLIGNTNPHPFLN KFNWKACRNLVDFYQQYLEQREKFLEAIKNQPWEPYQYCLLLK IPKENRKNLVKGWEQGGISLPRGLFTEAIRETLSEDLMLSKPI RKEIKKHGRVGFISRAITLYFKEKYQDKHQSFYNLSYKLEAKA PLLKREEHYEYWQQNKPQSPTESQRLELHTSDRWKDYLLYKRW QHLEKKLRLYRNQDVMLWLMTLELTKNHFKELNLNYHQLKLEN LAVNVQEADAKLNPLNQTLPMVLPVKVYPATAFGEVQYHKTPI RTVYIREEHTKALKMGNFKALVKDRRLNGLFSFIKEENDTQKH PISQLRLRRELEIYQSLRVDAFKETLSLEEKLLNKHTSLSSLE NEFRALLEEWKKEYAASSMVTDEHIAFIASVRNAFCHNQYPFY KEALHAPIPLFTVAQPTTEEKDGLGIAEALLKVLREYCEIVKS QI |
| *Porphyromonas gingivalis* (SEQ ID No. 145) | WP_052912312 | MTEQNEKPYNGTYYTLEDKHFWAAFFNLARHNAYITLAHIDRQ LAYSKADITNDEDILFFKGQWKNLDNDLERKARLRSLILKHFS FLEGAAYGKKLFESQSSGNKSSKKKELTKKEKEELQANALSLD NLKSILFDFLQKLKDFRNYYSHYRHPESSELPLFDGNMLQRLY NVFDVSVQRVKRDHENDKVDPHRHFNHLVRKGKKDKYGNNDN PFFKHHFVDREEKVTEAGLLFFVSLFLEKRDAIWMQKKIRGFK GGTEAYQQMTNEVFCRSRISLPKLKLESLRTDDWMLLDMLNEL VRCPKLLYDRLREEDRARFRVPVDILSDEDDTDGTEEDPFKNT LVRHQDRFPYFALRYFDLKKVFTSLRFHIDLGTYHFAIYKKNI GEQPEDRHLTRNLYGFGRIQDFAEEHRPEEWKRLVRDLDYFET GDKPYITQTTPHYHIEKGKIGLRFVPEGQLLWPSPEVGATRTG RSKYAQDKRFTAEAFLSVHELMPMMFYYFLLREKYSEEASAEK VQGRIKRVIEDVYAVYDAFARDEINTRDELDACLADKGIRRGH LPRQMIAILSQEHKDMEEKVRKKLQEMIADTDHRLDMLDRQTD RKIRIGRKNAGLPKSGVIADWLVRDMMRFQPVAKDTSGKPLNN SKANSTEYRMLQRALALFGGEKERLTPYFRQMNLTGGNNPHPF LHETRWESHTNILSFYRSYLKARKAFLQSIGRSDREENHRFLL LKEPKTDRQTLVAGWKSEFHLPRGIFTEAVRDCLIEMGYDEVG SYKEVGFMAKAVPLYFERACKDRVQPFYDYPFNVGNSLKPKKG RFLSKEKRAEEWESGKERFPRDLEAWSHSAARRIEDAFVGIEYA SWENKKKIEQLLQDLSLWETFESKLKVKADKINIAKLKKEILE AKEHPYHDFKSWQKFERELRLVKNQDIITWMMCRDLMEENKVE GLDTGTLYLKDIRTDVQEQGSLNVLNHVKPMRLPVVVYRADSR GHVHKEEAPLATVYIEERDTKLLKQGNFKSFVKDRRLNGLFSF VDTGALAMEQYPISKLRVEYELAKYQTARVCAFEQTLELEESL LTRYPHLPDESFREMLESWSDPLLDKWPDLQREVRLLIAVRNA FSHNQYPMYDETIFSSIRKYDPSSLDAIEERMGLNIAHRLSEE VKLAKEMVERIIQA |
| *Porphyromonas gingivalis* (SEQ ID No. 146) | WP_058019250 | MTEQNEKPYNGTYYTLKDKHFWAAFFNLARHNAYITLTHIDRQ LAYSKADITNDEDILFFKGQWKNLDNDLERKARLRSLILKHFS FLEGAAYGKKLFESQSSGNKSSKKKELTKKEKEELQANALSLD NLKSILFDFLQKLKDFRNYYSHYRHPESSELPMFDGNMLQRLY |

TABLE 3-continued

| | | |
|---|---|---|
| | | NVFDVSVQRVKRDHEHNDKVDPHRHFNHLVRKGKKDRCGNNDN
PFFKHHFVDREGKVTEAGLLFFVSLFLEKRDAIWMQKKIRGFK
GGTETYQQMTNEVFCRSRISLPKLKLESLRTDDWMLLDMLNEL
VRCPKSLYDRLREEDRACFRVPVDILSDEDDTDGAEEDPFKNT
LVRHQDRFPYFALRYFDLKKVFTSLRFHIDLGTYHFAIYKKNI
GEQPEDRHLTRNLYGFRIQDFAEEHRPEEWKRLVRDLDCFET
GDKPYITQTTPHYHIEKGKIGLRFVPEGQHLWPSPEVGATRTG
RSKYAQDKRFTAEAFLSVHELMPMMFYYFLLREKYSEEVSAER
VQGRIKRVIEDVYAVYDAFARDEINTRDELDACLADKGIRRGH
LPRQMIAILSQKHKDMEEKVRKKLQEMIADTDHRLDMLDRQTD
RKIRIGRKNAGLPKSGVIADWLVRDMMRFQPVAKDTSGKPLNN
SKANSTEYRMLQRALALFGGEKERLTPYFRQMNLTGGNNPHPF
LHETRWESHTNILSFYRSYLKARKAFLQSIGRSDRVENHRFLL
LKEPKTDRQTLVAGWKGEFHLPRGIFTEAVRDCLIEMGLDEVG
SYKEVGFMAKAVPLYFERACKDRVQPFYDYPFNVGNSLKPKKG
RFLSKEKRAEEWESGKERFRDLEAWSHSAARRIEDAFAGIENA
SRENKKKIEQLLQDLSLWETFESKLKVKADKINIAKLKKEILE
AKEHPYLDFKSWQKFERELRLVKNQDIITWMMCRDLMEENKVE
GLDTGTLYLKDIRTDVQEQGSLNVLNHVKPMRLPVVVYRADSR
GHVHKEQAPLATVYIEERDTKLLKQGNFKSFVKDRRLNGLFSF
VDTGALAMEQYPISKLRVEYELAKYQTARVCAFEQTLELEESL
LTRYPHLPDENFRKMLESWSDPLLDKWPDLHRKVRLLIAVRNA
FSHNQYPMYDEAVFSSIRKYDPSSPDAIEERMGLNIAHRLSEE
VKQAKEMAERIIQA |
| Flavobacterium
columnare
(SEQ ID
No. 147) | WP_060381855 | MSSKNESYNKQKTFNHYKQEDKYFFGGFLNNADDNLRQVGKEF
KTRINFNHNNNELASVFKDYFNKEKSVAKREHALNLLSNYFPV
LERIQKHTNHNFEQTREIFELLLDTIKKLRDYYTHHYHKPITI
NPKVYDFLDDTLLDVLITIKKKKVKNDTSRELLKEKFRPELTQ
LKNQKREELIKKGKKLLEENLENAVFNHCLRPFLEENKTDDKQ
NKTVSLRKYRKSKPNEETSITLTQSGLVFLISFFLHRKEFQVF
TSGLEGFKAKVNTIKEEEISLNKNNIVYMITHWSYSYYNFKGL
KHRIKTDQGVSTLEQNNTTHSLTNTNTKEALLTQIVDYLSKVP
NEIYETLSEKQQKEFEEDINEYMRENPENEDSTFSSIVSHKVI
RKRYENKFNYFAMRFLDEYAELPTLRFMVNFGDYIKDRQKKIL
ESIQFDSEMIKKEIHLFEKLGLVTEYKKNVYLKETSNIDLSRF
PLFPSPSYVMANNNIPFYIDSRSNNLDEYLNQKKKAQSQNRKR
NLTFEKYNKEQSKDAIIAMLQKEIGVKDLQQRSTIGLLSCNEL
PSMLYEVIVKDIKGAELENKIAQKIREQYQSIRDFTLDSPQKD
NIPTTLTKTISTDTSVTFENQPIDIPRLKNALQKELTLTQEKL
LNVKQHEIEVDNYNRNKNTYKFKNQPKDKVDDNKLQRKYVFYR
NEIGQEANWLASDLIHFMKNKSLWKGYMHNELQSFLAFFEDKK
NDCIALLETVFNLKEDCILTKDLKNLFLKHGNFIDFYKEYLKL
KEDFPLNTESTFLENGFIGLPPKILKKELSKRLNYIFIVFQKRQ
FIIKELEEKKNNLYADAINLSRGIFDEKPTMIPFKKPNPDEFA
SWFVASYQYNNYQSFYELTPDKIENDKKKKYKNLRAINKVKIQ
DYYLKLMVDTLYQDLFNQPLDKSLSDFYVSKTDREKIKADAKA
YQKRNDSFLWNKVIHLSLQNNRITANPKLKDIGKYKRALQDEK
IATLLTYDDRTWTYALQKPEKENENDYKELHYTALNMELQEYE
KVRSKKLLKQVQELEKQILDKFYDFSNNATHPEDLEIEDKKGK
RHPNFKLYITKALLKNESEIINLENIDIEILIKYYDYNTEKLK
EKIKNMDEDEKAKIVNTKENYNKITNVLIKKALVLIIIRNKMA
HNQYPPKFIYDLATRFVPKKEEEYFACYFNRVFETITTELWEN
KKKAKEIV |
| Porphyromonas
gingivalis
(SEQ ID
No. 148) | WP_061156470 | MTEQNERPYNGTYYTLEDKHFWAAFFNLARHNAYITLTHIDRQ
LAYSKADITNDEDILFFKGQWKNLDNDLERKARLRSLILKHFS
FLEGAAYGKKLFENKSSGNKSSKKKELTKKEKEELQANALSLD
NLKSILFDFLQKLKDFRNYYSHYRHPESSELPLFDGNMLQRLY
NVFDVSVQRVKRDHEHNDKVDPHRHFNHLVRKGKKDRCGNNDN
PFFKHHFVDREGKVTEAGLLFFVSLFLEKRDAIWMQKKIRGFK
GGTEAYQQMTNEVFCRSRISLPKLKLESLRTDDWMLLDMLNEL
VRCPKSLYDRLREEDRARFRVPVDILSDEDDTDGTEEDPFKNT
LVRHQDRFPYFALRYFDLKKVFTSLRFHIDLGTYHFAIYKKNI
GEQPEDRHLTRNLYGFRIQDFAEEHRPEEWKRLVRDLDYFET
GDKPYITQTTPHYHIEKGKIGLRFVPEGQHLWPSPEVGATRTG
RSKYAQDKRLTAEAFLSVHELMPMMFYYFLLREKYSEEVSAEK
VQGRIKRVIEDVYAVYDAFARGEIDTLDRLDACLADKGIRRGH
LPRQMIAILSQEHKDMEEKVRKKLQEMIADTDHRLDMLDRQTD
RKIRIGRKNAGLPKSGVIADWLVRDMMRFQPVAKDTSGKPLNN
SKANSTEYRMLQRALALFGGEKERLTPYFRQMNLTGGNNPHPF
LHETRWESHTNILSFYRSYLKARKAFLQSIGRSDREENHRFLL
LKEPKTDRQTLVAGWKSEFHLPRGIFTEAVRDCLIEMGYDEVG
SYKEVGFMAKAVPLYFERACKDRVQPFYDYPFNVGNSLKPKKG
RFLSKEKRAEEWESGKERFRLAKLKKEILEAKEHPYLDFKSWQ
KFERELRLVKNQDIITWMMCRDLMEENKVEGLDTGTLYLKDIR
TEVQEQGSLNVLNRVKPMRLPVVVYRADSRGHVHKEQAPLATV
YIEERDTKLLKQGNFKSFVKDRRLNGLFSFVDTGGLAMEQYPI
SKLRVEYELAKYQTARVCAFEQTLELEESLLTRCPHLPDKNFR
KMLESWSDPLLDKWPDLQREVWLLIAVRNAFSHNQYPMYDEAV |

TABLE 3-continued

| | | |
|---|---|---|
| | | FSSIRKYDPSSPDAIEERMGLNIAHRLSEEVKQAKEMAERIIQ<br>A |
| Porphyromonas<br>gingivalis<br>(SEQ ID<br>No. 149) | WP_061156637 | MNTVPASENKGQSRTVEDDPQYFGLYLNLARENLIEVESHVRI<br>KFGKKKLNEESLKQSLLCDHLLSVDRWTKVYGHSRRYLPFLHY<br>FDPDSQIEKDHDSKTGVDPDSAQRLIRELYSLLDFLRNDFSHN<br>RLDGTTFEHLEVSPDISSFITGTYSLACGRAQSRFADFFKPDD<br>FVLAKNRKEQLISVADGKECLTVSGLAFFICLFLDREQASGML<br>SRIRGFKRTDENWARAVHETFCDLCIRHPHDRLESSNTKEALL<br>LDMLNELNRCPRILYDMLPEEERAQFLPALDENSMNNLSENSL<br>NEESRLLWDGSSDWAEALTKRIRHQDRFPYLMLRFIEEMDLLK<br>GIRFRVDLGEIELDSYSKKVGRNGEYDRTITDHALAFGKLSDF<br>QNEEEVSRMISGEASYPVRFSLFAPRYAIYDNKIGYCHTSDPV<br>YPKSKTGEKRALSNPQSMGFISVHDLRKLLLMELLCEGSFSRM<br>QSGFLRKANRILDETAEGKLQFSALFPEMRHRFIPPQNPKSKD<br>RREKAETTLEKYKQEIKGRKDKLNSQLLSAFDMNQRQLPSRLL<br>DEWMNIRPASHSVKLRTYVKQLNEDCRLRLRKFRKDGDGKARA<br>IPLVGEMATFLSQDIVRMIISEETKKLITSAYYNEMQRSLAQY<br>AGEENRRQFRAIVAELHLLDPSSGHPFLSATMETAHRYTEDFY<br>KCYLEKKREWLAKTFYRPEQDENTKRRISVFFVPDGEARKLLP<br>LLIRRRMKEQNDLQDWIRNKQAHPIDLPSHLFDSKIMELLKVK<br>DGKKKWNEAFKDWWSTKYPDGMQPFYGLRRELNIHGKSVSYIP<br>SDGKKFADCYTHLMEKTVQDKKRELRTAGKPVPPDLAADIKRS<br>FHRAVNEREFMLRLVQEDDRLMLMAINKMMTDREEDILPGLKN<br>IDSILDKENQFSLAVHAKVLEKEGEGGDNSLSLVPATIEIKSK<br>RKDWSKYIRYRYDRRVPGLMSHFPEHKATLDEVKTLLGEYDRC<br>RIKIFDWAFALEGAIMSDRDLKPYLHESSSREGKSGEHSTLVK<br>MLVEKKGCLTPDESQYLILIRNKAAHNQFPCAAEMPLIYRDVS<br>AKVGSIEGSSAKDLPEGSSLVDSLWKKYEMIIRKILPILDPEN<br>RFFGKLLNNMSQPINDL |
| Riemerella<br>anatipestifer<br>(SEQ ID<br>No. 150) | WP_061710138 | MFFSFHNAQRVIFKHLYKAFDASLRMVKEDYKAHFTVNLTRDF<br>AHLNRKGKNKQDNPDFNRYRFEKDGFFTESGLLFFTNLFLDKR<br>DAYWMLKKVSGFKASHKQSEKMTTEVFCRSRILLPKLRLESRY<br>DHNQMLLDMLSELSRCPKLLYEKLSEKDKKCFQVEADGFLDEI<br>EEEQNPFKDTLIRHQDRFPYFALRYLDLNESFKSIRFQVDLGT<br>YHYCIYDKKIGYEQEKRHLTRTLLNFGRLQDFTEINRPQEWKA<br>LTKDLDYNETSNQPFISKTTPHYHITDNKIGFRLRTSKELYPS<br>LEVKDGANMAKYPYNSDFVAHAFISISVHELLPLNIFYQHLTG<br>KSEDLLKETVRHIQRIYKDFEEERINTIEDLEKANQGRLPLGA<br>FPKQMLGLLQNKQPDLSEKAKIKIEKLIAETKLLSHRLNTKLK<br>SSPKLGKRREKLIKTGVLADWLVKDFMRFQPVVYDAQNQPIKS<br>SKANSTESRLIRRALALYGGEKNRLEGYFKQTNLIGNTNPHPF<br>LNKFNWKACRNLVDFYQQYLEQREKFLEAIKHQPWEPYQYCLL<br>LKVPKENRKNLVKGWEQGGISLPRGLFTEAIRETLSKDLTLSK<br>PIRKEIKKHGRVGFISRAITLYFKEKYQDKHQSFYNLSYKLEA<br>KAPLLKKEEHYEYWQQNKPQSPTESQRLELHTSDRWKDYLLYK<br>RWQHLEKKLRLYRNQDIMLWLMTLELTKNHFKELNLNYHQLKL<br>ENLAVNVQEADAKLNPLNQTLPMVLPVKVYPTTAFGEVQYHET<br>PIRTVYIREEQTKALKMGNFKALVKDRHLNGLFSFIKEENDTQ<br>KHPISQLRLRRELEIYQSLRVDAFKETLSLEEKLLNKHASLSS<br>LENEFRTLLEEWKKKYAASSMVTDKHIAFIASVRNAFCHNQYP<br>FYKETLHAPILLFTVAQPTTEEKDGLGIAEALLRVLREYCEIV<br>KSQI |
| Flavobacterium<br>columnare<br>(SEQ ID<br>No. 151) | WP_063744070 | MSSKNESYNKQKTFNHYKQEDKYFFGGFLNNADDNLRQVGKEF<br>KTRINFNHNNNELASVFKDYFNKEKSVAKREHALNLLSNYFPV<br>LERIQKHTNHNFEQTREIFELLLDTIKKLRDYYTHHYHKPITI<br>NPKIYDFLDDTLLDVLITIKKKKVKNDTSRELLKEKLRPELTQ<br>LKNQKREELIKKGKKLLEENLENAVFNHCLRPPLEENKTDDKQ<br>NKTVSLRKYRKSKPNEETSITLTQSGLVFLMSFFLHRKEFQVF<br>TSGLEGFKAKVNTIKEEKISLNKNNIVYMITHWSYSYYNFKGL<br>KHRIKTDQGVSTLEQNNTTHSLTNTNTKEALLTQIVDYLSKVP<br>NEIYETLSEKQQKEFEEDINEYMRENPENEDSTFSSIVSHKVI<br>RKRYENKFNYFAMRFLDEYAELPTLRFMVNFGDYIKDRQKKIL<br>ESIQFDSEMIKKEIHLFEKLGLVTEYKKNVYLKETSNIDLSRF<br>PLFPSPSYVMANNNIPFYIDSRSNNLDEYLNQKKKAQSQNRKR<br>NLTFEKYNKEQSKDAIIAMLQKEIGVKDLQQRSTIGLLSCNEL<br>PSMLYEVIVKDIKGAELENKIAQKIREQYQSIRDFTLNSPQKD<br>NIPTTLIKTISTDTSVTFENQPIDIPRLKNAIQKELALTQEKL<br>LNVKQHEIEVNNYNRNKNTYKFKNQPKDKVDDNKLQRKYVFYR<br>NEIGQEANWLASDLIHFMKNKSLWKGYMHNELQSFLAFFEDKK<br>NDCIALLETVFNLKEDCILTKDLKNLFLKHGNFIDFYKEYLKL<br>KEDFLNTESTFLENGFIGLPPKILKKELSKRLNYIFIVFQKRQ<br>FIIKELEEKKNNLYADAINLSRGIFDEKPTMIPFKKPNPDEFA<br>SWFVASYQYNNYQSFYELTPDKIENDKKKKYKNLRAINKVKIQ<br>DYYLKLMVDTLYQDLFNQPLDKSLSDFYVSKTDREKIKADAKA<br>YQKRNDSFLWNKVIHLSLQNNRITANPKLKDIGKYKRALQDEK<br>IATLLTYDDRTWTYALQKPEKENENDYKELHYTALNMELQEYE |

TABLE 3-continued

| | | |
|---|---|---|
| | | KVRSKKLLKQVQELEKQILDKFYDFSNNATHPEDLEIEDKKGK<br>RHPNFKLYITKALLKNESEIINLENIDIEILIKYYDYNTEKLK<br>EKIKNMDEDEKAKIVNTKENYNKITNVLIKKALVLIIIRNKMA<br>HNQYPPKFIYDLATRFVPKKEEEYFACYFNRVFETITTELWEN<br>KKKAKEIV |
| *Riemerella<br>anatipestifer*<br>(SEQ ID<br>No. 152) | WP_064970887 | MEKPLPPNVYTLKHKFFWGAFLNIARHNAFITICHINEQLGLT<br>TPPNDDKIADVVCGTWNNILNNDHDLLKKSQLTELILKHFPFL<br>AAMCYHPPKKEGKKKGSQKEQQKEKENEAQSQAEALNPSELIK<br>VLKTLVKQLRTLRNYYSHESHKKPDAEKDIFKHLYKAFDASLR<br>MVKEDYKAHFTVNLTQDFAHLNRKGKNKQDNPDFDRYRFEKDG<br>FFTESGLLFFTNLFLDKRDAYWMLKKVSGFKASHKQSEKMTTE<br>VFCRSRILLPKLRLESRYDHNQMLLDMLSELSRYPKLLYEKLS<br>EEDKKRFQVEADGFLDEIEEEQNPFKDTLIRHQDRFPYFALRY<br>LDLNESFKSIRFQVDLGTYHYCIYDKKIGDEQEKRHLTRTLLS<br>FGRLQDFTEINRPQEWKALTKDLDYKETSKQPFISKTTPHYHI<br>TDNKIGFRLGTSKELYPSLEVKDGANRIAQYPYNSDFVAHAFI<br>SVHELLPLMFYQHLTGKSEDLLKETVRHIQRIYKDFEEERINT<br>IEDLEKANQGRLPLGAFPKQMLGLLQNKQPDLSEKAKIKIEKL<br>IAETKLLSHRLNTKLKSSPKLGKRREKLIKTGVLADWLVKDFM<br>RFQPVAYDAQNQPIESSKANSTEFQLIQRALALYGGEKNRLEG<br>YFKQTNLIGNTNPHPFLNKFNWKACRNLVDFYQQYLEQREKFL<br>EAIKNQPWEPYQYCLLLKIPKENRKNLVKGWEQGGISLPRGLF<br>TEAIRETLSKDLTLSKPIRKEIKKHGRVGFISRAITLYFREKY<br>QDDHQSFYDLPYKLEAKASPLPKKEHYEYWQQNKPQSPTELQR<br>LELHTSDRWKDYLLYKRWQHLEKKLRLYRNQDVMLWLMTLELT<br>KNHPKELNLNYHQLKLENLAVNVQEADAKLNPLNQTLPMVLPV<br>KVYPATAFGEVQYQETPIRTVYIREEQTKALKMGNFKALVKDR<br>RLNGLFSFIKEENDTQKHPISQLRLRRELEIYQSLRVDAFKET<br>LNLEEKLLKKHTSLSSVENKFRILLEEWKKEYAASSMVTDEHI<br>AFIASVRNAFCHNQYPPFYEEALHAPIPLFTVAQQTTEEKDGLG<br>IAEALLRVLREYCEIVKSQI |
| *Sinomicrobium<br>oceani*<br>(SEQ ID<br>No. 153) | WP_072319476.1 | MESTTTLGLHLKYQHDLFEDKHYFGGGVNLAVQNIESIFQAFA<br>ERYGIQNPLRKNGVPAINNIFHDNISISNYKEYLKFLKQYLPV<br>VGFLEKSNEINIFEFREDFEILINAIYKLRHFYTHYYHSPIKL<br>EDRFYTCLNELFVAVAIQVKKHKMKSDKTRQLLNKNLHQLLQQ<br>LIEQKREKLKDKKAEGEKVSLDTKSIENAVLNDAFVHLLDKDE<br>NIRLNYSSRLSEDIITKNGITLSISGLLFLLSLFLQRKEAEDL<br>RSRIEGFKGKGNELRFMATHWVFSYLNVKRIKHRLNTDFQKET<br>LLIQIADELSKVPDEVYKTLDHENRSKFLEDINEYIREGNEDA<br>SLNESTVVHGVIRKRYENKFHYLVLRYLDEFVDFPSLRFQVHL<br>GNYIHDRRDKVIDGTNFITNRVIKEPIKVFGKLSHVSKLKSDY<br>MESLSREHKNGWDVFPNPSYNFVGHNIPIFINLRSASSKGKEL<br>YRDLMKIKSEKKKKSREEGIPMERRDGKPTKIEISNQIDRNIK<br>DNNFKDIYPGEPLAMLSLNELPALLFELLRRPSITPQDIEDRM<br>VEKLYERFQIIRDYKPGDGLSTSKISKKLRKADNSTRLDGKKL<br>LRAIQTETRNAREKLHTLEENKALQKNRKRRTVYTTREQGREA<br>SWLAQDLKRFMPIASRKEWRGYHEISQLQQILAFYDQNPKQPL<br>ELLEQFWDLKEDTYVWNSWIHKSLSQHNGFVPMYEGYLKGRLG<br>YYKKLESDIIGFLEEHKVLKRYYTQQHLNVIFRERLYFIKTET<br>KQKLELLARPLVFPRGIFDDKPTFVQDKKVVDHPELFADWYVY<br>SYKDDHSFQEFYHYKRDYNEIFETELSWDIDFKDNKRQLNPSE<br>QMDLFRMKWDLKIKKKIKIQDIFLKIVAEDIYLKIFGHKIPLSL<br>SDFYISRQERLTLDEQAVAQSMRLPGDTSENQIKESNLWQTTV<br>PYEKEQIREPKIKLKDIGKFKYFLQQQKVLNLLKYDPQHWVTK<br>AELEEELYIGKHSYEVVRREMLLQKCHQLEKHILEQFRFDGSN<br>HPRELEQGNHPNFKMYIVNGILTKRGELEIEAENWWLELGNSK<br>NSLDKVEVELLTMKTIPEQKAFLLILIRNKFAHNQLPADNYFH<br>YASNLMNLKKSDTYSLFWFTVADTIVQEFMSL |
| *Reichenbachiella<br>agariperforans*<br>(SEQ ID<br>No. 154) | WP_073124441.1 | MKTNPLIASSGEKPNYKKFNTESDKSFKKIFQNKGSIAPIAEK<br>ACKNFEIKSKSPVNRDGRLHYFSVGHAFKNIDSKNVFRYELDE<br>SQMDMKPTQFLALQKEFFDFQGALNGLLKHIRNVNSHYVHTFE<br>KLEIQSINQKLITFLIEAFELAVIHSYLNEEELSYEAYKDDPQ<br>SGQKLVQFLCDKFYPNKEHEVEERKTILAKNKRQALEHLLFIE<br>VTSDIDWKLFEKHKVFTISNGKYLSFHACLELLSLFLYKSEAN<br>QLISKIKGFKRNDDNQYRSKRQIFTFFSKKFTSQDVNSEEQHL<br>VKFRDVIQYLNHYPSAWNKHLELKSGYPQMTDKLMRYIVEAEI<br>YRSFPDQTDNHRFLLFAIREFFGQSCLDTWTGNTPINFSNQEQ<br>KGFSYEINTSAEIKDIETKLKALVLKGPLNFKEKKEQNRLEKD<br>LRREKKEQPTNRVKEKLLTRIQHNMLYVSYGRNQDRFMDFAAR<br>FLAETDYFGKDAKFKMYQFYTSDEQRDHLKEQKKELPKKEFEK<br>LKYHQSKLVDYFTYAEQQARYPDWDTPFVVENNAIQIKVTLFN<br>GAKKIVSVQRNLMLYLLEDALYSEKRENAGKGLISGYFVHHQK<br>ELKDQLDILEKETEISREQKREFKKLLPKRLLHRYSPAQINDT<br>TEWNPMEVILEEAKAQERYQLLLEKAILHQTEEDFLKRNKGK<br>QFKLRFVRKAWHLMYLKELYMNKVAEHGHHKSFHITKEEENDF<br>CRWMFAFDEVPKYKEYLCDYFSQKGFFNNAEFKDLIESSTSLN<br>DLYEKTKQRFEGWSKDLTKQSDENKYLLANYESMLKDDMLYVN |

TABLE 3-continued

```
ISHFISYLESKGKINRNAHGHIAYKALNNVPHLIEEYYYKDRL
APEEYKSHGKLYNKLKTVKLEDALLYEMAMHYLSLEPALVPKV
KTKVKDILSSNIAFDIKDAAGHHLYHLLIPFHKIDSFVALINH
QSQQEKDPDKTSFLAKIQPYLEKVKNSKDLKAVYHYYKDTPHT
LRYEDLNMIHSHIVSQSVQFTKVALKLEEYFIAKKSITLQIAR
QISYSEIADLSNYFTDEVRNTAFHFDVPETAYSMILQGIESEF
LDREIKPQKPKSLSELSTQQVSVCTAFLETLHNNLFDRKDDKK
ERLSKARERYFEQIN
```

In certain example embodiments, the RNA-targeting effector protein is a Cas13c effector protein as disclosed in U.S. Provisional Patent Application No. 62/525,165 filed Jun. 26, 2017, and PCT Application No. US 2017/047193 filed Aug. 16, 2017. Example wildtype orthologue sequences of Cas13c are provided in Table 4B below. In certain example embodiments, the CRISPR effector protein is a Cas13c protein from Table 4a or 4b.

TABLE 4a

| | |
|---|---|
| *Fusobacterium necrophorum* subsp. *funduliforme* ATCC 51357 contig00003 (SEQ ID No. 155) | MEKERRQNRNSIIKIIISNYDTKGIKELKVRYRKQAQLDTFIIKTEI VNNDIFIKSIIEKAREKYRYSFLFDGEEKYHFKNKSSVEIVKKDIFS QTPDNMIRNYKITLKISEKNPRVVEAEIEDLMNSTILKDGRRSARRE KSMTERKLIEEKVAKNYSLLANCPMEEVDSIKIYKIKRFLTYRSNML LYFASINSFLCEGIKGKDNETEEIWHLKDNDVRKEKVRENFKNKLIQ STENYNSSLKNQIEEKEKLLRKEFKKGAFYRTIIKKLQQERIKELSE KSLTEDCEKIIKLYSKLRHSLMHYDYQYFENLFENKKNDDLMKDLNL DLFKSLPLIRKMKLNNKVNYLEDGDTLFVLQKTKKAKTLYQIYDALC EQKNGFNKFINDFFVSDGEENTVFKQIINEKFQSEMEFLEKRISESE KKNEKLKKKLDSMKAHFRNINSEDTKEAYFWDIHSSRNYKTKYNERK NLVNEYTELLGSSKEKKLLREEITKINRQLLKLKQEMEEITKKNSLF RLEYKMKIAFGPLFCEFDGNISKFKDEFDASNQEKIIQYHKNGEKYL TSFLKEEEKEKFNLEKMQKIIQKTEEEDWLLPETKNNLFKFYLLTYL LLPYELKGDFLGFVKKHYYDIKNVDFIDENQNNIQVSQTVEKQEDYF YHKIRLFEKNTKKYEIVKYSIVPNEKLKQYFEDLGIDIKYLTVEQKS EVSEEKNKKVSLKNNGMFNKTILLFVFKYYQIAFKLFNDIELYSLFF LREKSGKPLEIFRKELESKMKDGYLNFGQLLYVVYEVLVKNKDLDKI LSKKIDYRKDKSFSPEIAYLRNFLSHLNYSKFLDNFMKINTNKSDEN KEVLIPSIKIQKMIQFIEKCNLQNQIDFDFNFVNDFYMRKEKMFFIQ LKQIFPDINSTEKQKMNEKEEILRNRYHLTDKKNEQIKDEHEAQSQL YEKILSLQKIYSSDKNNFYGRLKEEKLLFLEKQGKKKLSMEEIKDKI AGDISDLLGILKKEITRDIKDKLTEKFRYCEEKLLNLSFYNHQDKKK EESIRVFLIRDKNSDNFKFESILDDGSNKIFISKNGKEITIQCCDKV LETLIIEKNTLKISSNGKIISLIPHYSYSIDVKY |
| *Fusobacterium necrophorum* DJ-2 contig0065, whole genome shotgun sequence (SEQ ID No. 156) | MEKFRRQNRNSSIIKIIISNYDTKGIKELKVRYRKQAQLDTFIIKTEI VNNDIFIKSIIEKAREKYRYSFLFDGEEKYHFKNKSSVEIVKKDIFS QTPDNMIRNYKITLKISEKNPRVVEAEIEDLMNSTILKDGRRSARRE KSMTERKLIEEKVAENYSLLANCPMEEVDSIKIYKIKRFLTYRSNML LYFASINSFLCEGIKGKDNETEEIWHLKDNDVRKEKVKENFKNKLIQ STENYNSSLKNQIEEKEKLLRKESKKGAFYRTIIKKLQQERIKELSE KSLTEDCEKIIKLYSELRHPLMHYDYQYFENLFENKENSELTKNLNL DIFKSLPLVRKMKLNNKVNYLEDNDTLFVLQKTKKAKTLYQIYDALC EQKNGFNKFINDFFVSDGEENTVFKQIINEKFQSEIEFLEKRISESE KKNEKLKKKLDSMKAHFRNINSEDTKEAYFWDIHSSRNYKTKYNERK NLVNEYTELLGSSKEKKLLREEITKINRQLLKLKQEMEEITKKNSLF RLEYKMKMAFGPLFCEFDGNISRFKDEFDASNQEKIIQYHKNGEKYL TYFLKEEEKEKFNLKKLQETIQKTGEENWLLPQNKNNLEKFYLLTYL LLPYELKGDFLGFVKKHYYDIKNVDFMDENQSSKIIESKEDDFYHKI RLFEKNTKKYEIVKYSIVPDKKLKQYFKDLGIDTKYLILDQKSEVSG EKNKKVSLKNNGMENKTILLFVFKYQIAFKLENDIELYSLEFLREK SGKPFEVELKELKDKMIGKQLNEGQLLYVVYEVLVKNKDLSEILSER IDYRKDMCFSAEIADLRNFLSHLNYSKFLDNFMKINTNKSDENKEVL IPSIKIQKMIKFIEECNLQSQIDFDENFVNDFYMRKEKMFFIQLKQI FPDINSTEKQKMNEKEEILRNRYHLTDKKNEQIKDEHEAQSQLYEKI LSLQKIYSSDKNNFYGRLKEEKLLFLEKQEKKKLSMEEIKDKIAGDI SDLLGILKKEITRDIKDKLTEKFRYCEEKLLNLSFYNHQDKKKEESI RVFLIRDKNSDNEKFESILDDGSNKIFISKNGKEITIQCCDKVLETL IIEKNTLKISSNGKIISLIPHYSYSIDVKY |
| *Fusobacterium necrophorum* BFTR-1 contig0068 (SEQ ID No. 157) | MKVRYRKQAQLDTFIIKTEIVNNDIFIKSIIEKAREKYRYSFLEDGE EKYHFKNKSSVEIVKNDIFSQTPDNMIRNYKITLKISEKNPRVVEAE IEDLMNSTILKDGRRSARREKSMTERKLIEEKVAENYSLLANCPIEE VDSIKIYKIKRFLTYRSNMLLYFASINSFLCEGIKGKDNETEEIWHL KDNDVRKEKVKENFKNKLIQSTENYNSSLKNQIEEKEKLSSKEFKKG AFYRTIIKKLQQERIKELSEKSLTEDCEKIIKLYSELRHPLMHYDYQ YFENLFENKENSELTKNLNLDIFKSLPLVRKMKLNNKVNYLEDNDTL FVLQKTKKAKTLYQIYDALCEQKNGFNKFINDFFVSDGEENTVEKQI INEKEQSEMEFLEKRISESEKKNEKLKKKLDSMKAHFRNINSEDTKE AYFWDIHSSRNYKTKYNERKNLVNEYTKLLGSSKEKKLLREEITKIN RQLLKLKQEMEEITKKNSLFRLEYKMKIAFGPLFCEFDGNISKFKDE |

TABLE 4a-continued

| | |
|---|---|
| | FDASNQEKIIQYHKNGEKYLTSELKEEEKEKENLEKMQKIIQKTEEE<br>DWLLPETKNNLEKEYLLTYLLLPYELKGDFLGFVKKHYYDIKNVDEM<br>DENQNNIQVSQTVEKQEDYFYHKIRLFEKNTKKYEIVKYSIVPNEKL<br>KQYFEDLGIDIKYLTGSVESGEKWLGENLGIDIKYLTVEQKSEVSEE<br>KNKKVSLKNNGMENKTILLFVEKYYQIAFKLENDIELYSLFFLREKS<br>EKPFEVFLEELKDKMIGKQLNEGQLLYVVYEVLVKNKDLDKILSKKI<br>DYRKDKSFSPEIAYLRNFLSHLNYSKFLDNFMKINTNKSDENKEVLI<br>PSIKIQKMIQFIEKCNLQNQIDFDFNFVNDFYMRKEKMFFIQLKQIF<br>PDINSTEKQKKSEKEEILRKRYHLINKKNEQIKDEHEAQSQLYEKIL<br>SLQKIFSCDKNNFYRRLKEEKLLFLEKQGKKKISMKEIKDKIASDIS<br>DLLGILKKEITRDIKDKLTEKFRYCEEKLLNISFYNHQDKKKEEGIR<br>VFLIRDKNSDNFKFESILDDGSNKIFISKNGKEITIQCCDKVLETLM<br>IEKNTLKISSNGKIISLIPHYSYSIDVKY |
| Fusobacterium<br>necrophorum<br>subsp.<br>funduliforme<br>1_1_36S<br>cont1.14 (SEQ<br>ID No.158) | MTEKKSIIFKNKSSVEIVKKDIFSQTPDNMIRNYKITLKISEKNPRV<br>VEAEIEDLMNSTILKDGRRSARREKSMTERKLIEEKVAENYSLLANC<br>PMEEVDSIKIYKIKRFLTYRSNMLLYFASINSFLCEGIKGKDNETEE<br>IWHLKDNDVRKEKVKENFKNKLIQSTENYNSSLKNQIEEKEKLLRKE<br>SKKGAFYRTIIKKLQQERIKELSEKSLTEDCEKIIKLYSELRHPLMH<br>YDYQYFENLFENKENSELTKNLNLDIFKSLPLVRKMKLNNKVNYLED<br>NDTLFVLQKTKKAKTLYQIYDALCEQKNGFNKFINDFFVSDGEENTV<br>FKQIIINEKFQSEMEFLEKRISESEKKNEKLKKKFDSMKAHFHNINSE<br>DTKEAYFWDIHSSSNYKTKYNERKNLVNEYTELLGSSKEKKLLREEI<br>TQINRKLLKLKQEMEEITKKNSLFRLEYKMKIAFGFLFCEFDGNISK<br>FKDEFDASNQEKIIQYHKNGEKYLTYFLKEEEKEKFNLEKMQKIIQK<br>TEEEDWLLPETKNNLFKFYLLTYLLLPYELKGDFLGFVKKHYYDIKN<br>VDFMDENQNNIQVSQTVEKQEDYFYHKIRLFEKNTKKYEIVKYSIVP<br>NEKLKQYFEDLGIDIKYLTGSVESGEKWLGENLGIDIKYLTVEQKSE<br>VSEEKIKKFL |
| Fusobacterium<br>perfoetens<br>ATCC29250<br>T364DRAFT_scaffold<br>00009.9_C<br>(SEQ ID<br>No. 159) | MGKPNRSSIIKIISNYDNKGIKEVKVRYNKQAQLDTFLIKSELKDG<br>KFILYSIVDKAREKYRYSFEIDKTNINKNEILIIKKDIYSNKEDKVI<br>RKYILSFEVSEKNDRTIVTKIKDCLETQKKEKFERENTRRLISETER<br>KLLSEETQKTYSKIACCSPEDIDSVKIYKIKRYLAYRSNMLLFFSLI<br>NDIFVKGVVKDNGEEVGEIWRIIDSKEIDEKKTYDLLVENFKKRMSQ<br>EFINYKQSIENKIEKNTNKIKEIEQKLKKEKYKKEINRLKKQLIELN<br>RENDLLEKDKIELSDEEIREDIEKILKIYSDLRHKLMHYNYQYFENL<br>FENKKISKEKNEDVNLTELLDLNLFRYLPLVRQLKLENKTNYLEKED<br>KITVLGVSDSAIKYYSYYNFLCEQKNGFNNFINSFFSNDGEENKSFK<br>EKINLSLEKEIEIMEKETNEKIKEINKNELQLMKEQKELGTAYVLDI<br>HSLNDYKISHNERNKNVKLQNDIMNGNRDKNALDKINKKLVELKIKM<br>DKITKRNSILRLKYKLQVAYGFLMEEYKGNIKKFKDEFDISKEKIKS<br>YKSKGEKYLEVKSEKKYITKILNSIEDIHNITWLKNQEENNLFKFYV<br>LTYILLPFEFRGDFLGFVKKHYYDIKNVEFLDENNDRLTPEQLEKMK<br>NDSFFNKIRLFEKNSKKYDILKESILTSERIGKYFSLLNTGAKYFEY<br>GGEENRGIFNKNIIIPIFKYYQIVLKLYNDVELAMLLTLSEEDEKDI<br>NKIKELVTLKEKVSPKKIDYEKKYKFSVLLDCFNRIINLGKKDFLAS<br>EEVKEVAKTFTNLAYLRNKICHLNYSKFIDDLLTIDTNKSTTDSEGK<br>LLINDRIRKLIKFIRENNQKMNISIDYNYINDYYMKKEKFIFGQRKQ<br>AKTIIDSGKKANKRNKAEELLKMYRVKKENINLIYELSKKLNELTKS<br>ELFLLDKKLLKDIDFTDVKIKNKSFFELKNDVKEVANIKQALQKHSS<br>ELIGIYKKEVIMAIKRSIVSKLIYDEEKVLSIIIYDKTNKKYEDFLL<br>EIRRERDINKFQFLIDEKKEKLGYEKIIETKEKKKVVVKIQNNSELV<br>SEPRIIKNKDKKAKTPEEISKLGILDLTNHYCFNLKITL |
| Fusobacterium<br>ulcerans ATCC<br>49185 cont2.38<br>(SEQ ID No.<br>160) | MENKGNNKKIDFDENYNILVAQIKEYFTKEIENYNNRIDNIIDKKEL<br>LKYSEKKEESEKNKKLEELNKLKSQKLKILTDEEIKADVIKIIKIFS<br>DLRHSLMHYEYKYFENLFENKKNEELAELLNLNLFKNLTLLRQMKIE<br>NKTNYLEGREEFNIIGKNIKAKEVLGHYNLLAEQKNGFNNFINSFFV<br>QDGTENLEFKKLIDEHFVNAKKRLERNIKKSKKLEKELEKMEQHYQR<br>LNCAYVWDIHTSTTYKKLYNKRKSLIEEYNKQINEIKDKEVITAINV<br>ELLRIKKEMEEITKSNSLFRLKYKMQIAYAFLEIEFGGNIAKFKDEF<br>DCSKMEEVQKYLKKGVKYLKYYKDKEAQKNYEFPFEEIFENKDTHNE<br>EWLENTSENNLFKYILTYLLLPMEFKGDFLGVVKKHYYDIKNVDFT<br>DESEKELSQVQLDKMIGDSFFHKIRLFEKNTKRYEIIKYSILTSDEI<br>KRYFRLLELDVPYFEYEKGTDEIGIFNKNIILTIFKYYQIIFRLYND<br>LEIHGLFNISSDLDKILRDLKSYGNKNINFREFLYVIKQNNNSSTEE<br>EYRKIWENLEAKYLRLHLLTPEKEEIKTKTKEELEKLNEISNLRNGI<br>CHLNYKEIIEEILKTEISEKNKEATLNEKIRKVINFIKENELDKVEL<br>GFNFINDFFMKKEQFMFGQIKQVKEGNSDSITTERERKEKNNKKLKE<br>TYELNCDNLSEFYETSNNLRERANSSSLLEDSAFLKKIGLYKKNNK<br>VNSKVKDEEKRIENIKRKLLKDSSDIMGMYKAEVVKKLKEKLILIFK<br>HDEEKRIYVTVYDTSKAVPENISKEILVKRNNSKEEYFFEDNNKKYV<br>TEYYTLEITETNELKVIPAKKLEGKEFKTEKNKENKLMLNNHYCFNV<br>KIIY |
| Anaerosalibacter<br>sp. ND1<br>genome<br>assembly | MKSGRREKAKSNKSSIVRVIISNFDDKQVKEIKVLYTKQGGIDVIKF<br>KSTEKDEKGRMKFNFDCAYNRLEEEEFNSFGGKGKQSFFVTTNEDLT<br>ELHVTKRHKTTGEIIKDYTIQGKYTPIKQDRTKVTVSITDNKDHFDS<br>NDLGDKIRLSRSLTQYTNRILLDADVMKNYREIVCSDSEKVDETINI |

TABLE 4a-continued

| | |
|---|---|
| Anaerosalibacter massiliensis ND1 (SEQ ID No. 161) | DSQEIYKINRFLSYRSNMIIYYQMINNFLLHYDGEEDKGGNDSINLI NEIWKYENKKNDEKEKIIERSYKSIEKSINQYILNHNTEVESGDKEK KIDISEERIKEDLKKTFILFSRLRHYMVHYNYKFYENLYSGKNFIIY NKDKSKSRRFSELLDLNIFKELSKIKLVKNRAVSNYLDKKTTIHVLN KNINAIKLLDIYRDICETKNGFNNFINNMMTISGEEDKEYKEMVTKH FNENMNKLSIYLENFKKHSDFKTNNKKKETYNLLKQELDEQKKLRLW FNAPYVYDIHSSKKYKELYVERKKYVDIHSKLIEAGINNDNKKKLNE INVKLCELNTEMKEMTKLNSKYRLQYKLQLAFGFILEEFNLDIDKFV SAFDKDNNLTISKFMEKRETYLSKSLDRRDNRFKKLIKDYKFRDTED IFCSDRENNLVKLYILMYILLPVEIRGDFLGFVKKNYYDLKHVDFID KRNNDNKDTFFHDLRLFEKNVKRLEVTSYSLSDGFLGKKSREKFGKE LEKFIYKNVSIALPTNIDIKEFNKSLVLPMMKNYQIIFKLLNDIEIS ALFLIAKKEGNEGSITFKKVIDKVRKEDMNGNINFSQVMKMALNEKV NCQIRNSIAHINMKQLYIEPLNIYINNNQNKKTISEQMEEIIDICIT KGLTGKELNKNIINDYYMKKEKLVFNLKLRKRNNLVSIDAQQKNMKE KSILNKYDLNYKDENLNIKEIILKVNDLNNKQKLLKETTEGESNYKN ALSKDILLLNGIIRKNINFKIKEMILGIIQQNEYRYVNINIYDKIRK EDHNIDLKINNKYIEISCYENKSNESTDERINFKIKYMDLKVKNELL VPSCYEDIYIKKKIDLEIRYIENCKVVYIDIYYKKYNINLEFDGKTL FVKFNKDVKKNNQKVNLESNYIQNIKFIVS |

TABLE 4B

| Name | Sequence |
|---|---|
| EHO19081 | MTEKKSIIFKNKSSVEIVKKDIFSQTPDNMIRNYKITLKISEKNPRVVEA EIEDLMNSTILKDGRRSARREKSMTERKLIEEKVAENYSLLANCPMEEVD SIKIYKIKRFLTYRSNMLLYFASINSFLCEGIKGKDNETEEIWHLKDNDV RKEKVKENFKNKLIQSTENYNSSLKNQIEEKEKLLRKESKKGAFYRTIIK KLQQERIKELSEKSLTEDCEKIIKLYSELRHPLMHYDYQYFENLFENKEN SELTKNLNLDIFKSLPLVRKMKLNNKVNYLEDNDTLFVLQKTKKAKTLYQ IYDALCEQKNGFNKFINDFFVSDGEENTVFKQIINEKFQSEMEFLEKRIS ESEKKNEKLKKKFDSMKAHFHNINSEDTKEAYFWDIHSSSNYKTKYNERK NLVNEYTELLGSSKEKKLLREEITQINRKLLKLKQEMEEITKKNSLFRLE YKMKIAFGPLFCEFDGNISKFKDEFDASNQEKIIQYHKNGEKYLTYFLKE EEKEKFNLEKMQKIIQKTEEEDWLLPETKNNLFKFYLLTYLLLPYELKGD FLGFVKKHYYDIKNVDFMDENQNNIQVSQTVEKQEDYFYHKIRLFEKNTK KYEIVKYSIVPNEKLKQYFEDLGIDIKYLTGSVESGEKWLGENLGIDIKY LTVEQKSEVSEEKIKKFL |
| WP_094899336 | MEKDKKGEKIDISQEMIEEDLRKILILFSRLRHSMVHYDYEFYQALYSGK DFVISDKNNLENRMISQLLDLNIFKELSKVKLIKDKAISNYLDKNTTIHV LGQDIKAIRLLDIYRDICGSKNGFNKFINTMITISGEEDREYKEKVIEHF NKKMENLSTYLEKLEKQDNAKRNNKRVYNLLKQKLIEQQKLKEWFGGPYV YDIHSSKRYKELYIERKKLVDRHSKLFEEGLDEKNKKELTKINDELSKLN SEMKEMTKLNSKYRLQYKLQLAFGFILEEFDLNIDTFINNFDKDKDLIIS NFMKKRDIYLNRVLDRGDNRLKNIIKEYKFRDTEDIFCNDRDNNLVKLYI LMYILLPVEIRGDFLGFVKKNYYDMKHVDFIDKKDKEDKDTFFHDLRLFE KNIRKLEITDYSLSSGFLSKEHKVDIEKKINDFINRNGAMKLPEDITIEE FNKSLILPIMKNYQINFKLLNDIEISALFKIAKDRSITFKQAIDEIKNED IKKNSKKNDKNNHKDKNINFTQLMKRALHEKIPYKAGMYQIRNNISHIDM EQLYIDPLNSYMNSNKNNITISEQIEKIIDVCVTGGVTGKELNNNIINDY YMKKEKLVFNLKLRKQNDIVSIESQEKNKREEFVFKKYGLDYKDGEINII EVIQKVNSLQEELRNIKETSKEKLKNKETLFRDISLINGTIRKNINFKIK EMVLDIVRMDEIRHINIHIYYKGENYTRSNIIKFKYAIDGENKKYYLKQH EINDINLELKDKFVTLICNMDKHPNKNKQTINLESNYIQNVKFIIP |
| WP_040490876 | MENKGNNKKIDFDENYNILVAQIKEYFTKEIENYNNRIDNIIDKKELLKY SEKKEESEKNKKLEELNKLKSQKLKILTDEEIKADVIKIIKIFSDLRHSL MHYEYKYFENLFENKKNEELAELLNLNLFKNLTLLRQMKIENKTNYLEGR EEFNIIGKNIKAKEVLGHYNLLAEQKNGFNNFINSFFVQDGTENLEFKKL IDEHFVNAKKRLERNIKKSKKLEKELEKMEQHYQRLNCAYVWDIHTSTTY KKLYNKRKSLIEEYNKQINEIKDKEVITAINVELLRIKKEMEEITKSNSL FRLKYKMQIAYAFLEIEFGGNIAKFKDEFDCSKMEEVQKYLKKGVKYLKY YKDKEAQKNYEFPFEEIFENKDTHNEEWLENTSENNLFKFYILTYLLLPM EFKGDFLGVVKKHYYDIKNVDFTDESEKELSQVQLDKMIGDSFFHKIRLF EKNTKRYEIIKYSILTSDEIKRYFRLLELDVPYFEYEKGTDEIGIFNKNI ILTIFKYYQIIFRLYNDLEIHGLFNISSDLDKILRDLKSYGNKNINFREF LYVIKQNNNSSTEEEYRKIWENLEAKYLRLHLLTPEKEEIKTKTKEELEK LNEISNLRNGICHLNYKEIIEEILKTEISEKNKEATLNEKIRKVINFIKE NELDKVELGFNFINDFFMKKEQFMFGQIKQVKEGNSDSITTERERKEKNN KKLKETYELNCDNLSEFYETSNNLRERANSSSLLEDSAFLKKIGLYKVKN NKVNSKVKDEEKRIENIKRKLLKDSSDIMGMYKAEVVKKLKEKLILIFKH DEEKRIYVTVYDTSKAVPENISKEILVKRNNSKEEYFFEDNNKKYVTEYY TLEITETNELKVIPAKKLEGKEFKTKENKENKLMLNNHYCFNVKIIY |

TABLE 4B-continued

| Name | Sequence |
|---|---|
| WP_047396607 | MEEIKHKKNKSSIIRVIVSNYDMTGIKEIKVLYQKQGGVDTFNLKTIINL<br>ESGNLEIISCKPKEREKYRYEFNCKTEINTISITKKDKVLKKEIRKYSLE<br>LYFKNEKKDTVVAKVTDLLKAPDKIEGERNHLRKLSSSTERKLLSKTLCK<br>NYSEISKTPIEEIDSIKIYKIKRFLNYRSNFLIYFALINDFLCAGVKEDD<br>INEVWLIQDKEHTAFLENRIEKITDYIFDKLSKDIENKKNQFEKRIKKYK<br>TSLEELKTETLEKNKTFYIDSIKTKITNLENKITELSLYNSKESLKEDLI<br>KIISIFTNLRHSLMHYDYKSFENLFENIENEELKNLLDLNLFKSIRMSDE<br>FKTKNRTNYLDGTESFTIVKKHQNLKKLYTYYNNLCDKKNGFNTFINSFF<br>VTDGIENTDFKNLIILHFEKEMEEYKKSIEYYKIKISNEKNKSKKEKLKE<br>KIDLLQSELINMREHKNLLKQIYFFDIHNSIKYKELYSERKNLIEQYNLQ<br>INGVKDVTAINHINTKLLSLKNKMDKITKQNSLYRLKYKLKIAYSFLMIE<br>FDGDVSKFKNNFDPTNLEKRVEYLDKKEEYLNYTAPKNKFNFAKLEEELQ<br>KIQSTSEMGADYLNVSPENNLFKFYILTYIMLPVEFKGDFLGFVKNHYYN<br>IKNVDFMDESLLDENEVDSNKLNEKIENLKDSSFFNKIRLFEKNIKKYEI<br>VKYSVSTQENMKEYFKQLNLDIPYLDYKSTDEIGIFNKNMILPIFKYYQN<br>VFKLCNDIEIHALLALANKKQQNLEYAIYCCSKKNSLNYNELLKTFNRKT<br>YQNLSFIRNKIAHLNYKELFSDLFNNELDLNTKVRCLIEFSQNNKFDQID<br>LGMNFINDYYMKKTRFIFNQRRLRDLNVPSKEKIIDGKRKQQNDSNNELL<br>KKYGLSRTNIKDIFNKAWY |
| WP_035935671 | MKVRYRKQAQLDTFIIKTEIVNNDIFIKSIIEKAREKYRYSFLFDGEEKY<br>HFKNKSSVEIVKNDIFSQTPDNMIRNYKITLKISEKNPRVVEAEIEDLMN<br>STILKDGRRSARREKSMTERKLIEEKVAENYSLLANCPIEEVDSIKIYKI<br>KRFLTYRSNMLLYFASINSFLCEGIKGKDNETEEIWHLKDNDVRKEKVKE<br>NFKNKLIQSTENYNSSLKNQIEEKEKLSSKEFKKGAFYRTIIKKLQQERI<br>KELSEKSLTEDCEKIIKLYSELRHPLMHYDYQYFENLFENKENSELTKNL<br>NLDIFKSLPLVRKMKLNNKVNYLEDNDTLFVLQKTKKAKTLYQIYDALCE<br>QKNGFNKFINDFFVSDGEENTVFKQIINEKFQSEMEFLEKRISESEKKNE<br>KLKKKLDSMKAHFRNINSEDTKEAYFWDIHSSRNYKTKYNERKNLVNEYT<br>KLLGSSKEKKLLREEITKINRQLLKLKQEMEEITKKNSLFRLEYKMKIAF<br>GFLFCEFDGNISKFKDEFDASNQEKIIQYHKNGEKYLTSFLKEEEKEKFN<br>LEKMQKIIQKTEEEDWLLPETKNNLFKFYLLTYLLLPYELKGDFLGFVKK<br>HYYDIKNVDFMDENQNNIQVSQTVEKQEDYFYHKIRLFEKNTKKYEIVKY<br>SIVPNEKLKQYFEDLGIDIKYLTGSVESGEKWLGENLGIDIKYLTVEQKS<br>EVSEEKNKKVSLKNNGMFNKTILLFVFKYYQIAFKLFNDIELYSLFFLRE<br>KSEKPFEVFLEELKDKMIGKQLNFGQLLYVVYEVLVKNKDLDKILSKKID<br>YRKDKSFSPEIAYLRNFLSHLNYSKFLDNFMKINTNKSDENKEVLIPSIK<br>IQKMIQFIEKCNLQNQIDFDFNFVNDFYMRKEKMFFIQLKQIFPDINSTE<br>KQKKSEKEEILRKRYHLINKKNEQIKDEHEAQSQLYEKILSLQKIFSCDK<br>NNFYRRLKEEKLLFLEKQGKKKISMKEIKDKIASDISDLLGILKKEITRD<br>IKDKLTEKFRYCEEKLLNISFYNHQDKKKEEGIRVFLIRDKNSDNFKFES<br>ILDDGSNKIFISKNGKEITIQCCDKVLETLMIEKNTLKISSNGKIISLIP<br>HYSYSIDVKY |
| WP_035906563 | MEKFRRQNRSSIIKIIISNYDTKGIKELKVRYRKQAQLDTFIIKTEIVNN<br>DIFIKSIIEKAREKYRYSFLFDGEEKYHFKNKSSVEIVKKDIFSQTPDNM<br>IRNYKITLKISEKNPRVVEAEIEDLMNSTILKDGRRSARREKSMTERKLI<br>EEKVAENYSLLANCPMEEVDSIKIYKIKRFLTYRSNMLLYFASINSFLCE<br>GIKGKDNETEEIWHLKDNDVRKEKVKENFKNKLIQSTENYNSSLKNQIEE<br>KEKLLRKESKKGAFYRTIIKKLQQERIKELSEKSLTEDCEKIIKLYSELR<br>HPLMHYDYQYFENLFENKENSELTKNLNLDIFKSLPLVRKMKLNNKVNYL<br>EDNDTLFVLQKTKKAKTLYQIYDALCEQKNGFNKFINDFFVSDGEENTVF<br>KQIINEKFQSEIEFLEKRISESEKKNEKLKKKLDSMKAHFRNINSEDTKE<br>AYFWDIHSSRNYKTKYNERKNLVNEYTELLGSSKEKKLLREEITKINRQL<br>LKLKQEMEEITKKNSLERLEYKMKMAFGELECEFDGNISREKDEFDASNQ<br>EKIIQYHKNGEKYLTYELKEEEKEKENLKKLQETIQKTGEENWLLPQNKN<br>NLEKFYLLTYLLLPYELKGDFLGEVKKHYYDIKNVDFMDENQSSKIIESK<br>EDDFYHKIRLFEKNTKKYEIVKYSIVPDKKLKQYFKDLGIDTKYLILDQK<br>SEVSGEKNKKVSLKNNGMENKTILLFVFKYYQIAFKLENDIELYSUELRE<br>KSGKPFEVFLKELKDKMIGKQLNFGQLLYVVYEVLVKNKDLSEILSERID<br>YRKDMCFSAEIADLRNFLSHNYSKELDNEMKINTNKSDENKEVLIPSIKI<br>QKMIKFIEECNLQSQIDEDENEVNDEYMRKEKMFFIQLKQIEPDINSTEK<br>QKMNEKEEILRNRYHLTDKKNEQIKDEHEAQSQLYEKILSLQKIYSSDKN<br>NFYGRLKEEKLLFLEKQEKKKLSMEEIKDKIAGDISDLLGILYKKEITRDI<br>KDKLTEKFRYCEEKLLNLSFYNHQDKKKEESIRVFLIRDKNSDNEKEESI<br>LDDGSNKIFISKNGKEITIQCCDKVLETLIIEKNTLKISSNGKIISLIPH<br>YSYSIDVKY |
| WP_042678931 | MKSGRREKAKSNKSSIVRVIISNFDDKQVKEIKVLYTKQGGIDVIKFKST<br>EKDEKGRMKFNFDCAYNRLEEEEFNSFGGKGKQSFFVTTNEDLTELHVTK<br>REIKTTGEIIKDYTIQGKYTPIKQDRTKVTVSITDNKDHFDSNDLGDKIR<br>LSRSLTQYTNRILLDADVMKNYREIVCSDSEKVDETINIDSGEIYKINRE<br>LSYRSNMITYYQMINNELLHYDGEEDKGGNDSINLINEIWKYENKKNDEK<br>EKIIERSYKSIEKSINQYILNHNTEVESGDKEKKIDISEERIKEDLKKTF<br>ILESRLRHYMVHYNYKFYENLYSGKNFIIYNKDKSKSRRFSELLDLNIFK<br>ELSKIKLVKNRAVSNYLDKKTTIHVLNKNINAIKLLDIYRDICETKNGEN<br>NEINNMMTISGEEDKEYKEMVTKHFNENMNKLSIYLENEKKHSDFKTNNK |

TABLE 4B-continued

| Name | Sequence |
|---|---|
| | KKETYNLLKQELDEQKKLRLWFNAPYVYDIHSSKKYKELYVERKKYVDIH<br>SKLIEAGINNDNKKKLNEINVKLCELNTEMKEMTKLNSKYRLQYKLQLAF<br>GEILEEENLDIDKEVSAFDKDNNLTISKFMEKRETYLSKSLDRRDNRFKK<br>LIKDYKFRDTEDIFCSDRENNLVKLYILMYILLPVEIRGDFLGEVKKNYY<br>DLKHVDEIDKRNNDNKDTFEHDLRLEEKNVKRLEVTSYSLSDGFLGKKSR<br>EKFGKELEKFIYKNVSIALPTNIDIKEFNKSLVLPMMKNYQIIFKLLNDI<br>EISALFLIAKKEGNEGSITFKKVIDKVRKEDMNGNINFSQVMKMALNEKV<br>NCQIRNSIAHINMKQLYIEPLNIYINNNQNKKTISEQMEEIIDICITKGL<br>TGKELNKNIIINDYYMKKEKLVFNLKLRKRNNLVSIDAQQKNMKEKSILNK<br>YDLNYKDENLNIKEIILKVNDLNNKQKLLKETTEGESNYKNALSKDILLL<br>NGIIRKNINFKIKEMILGIIQQNEYRYVINIYDKIRKEDHNIDLKINNK<br>YIEISCYENKSNESTDERINFKIKYMDLKVKNELLVPSCYEDIYIKKKID<br>LEIRYIENCKVVYIDIYYKKYNINLEEDGKTLEVKENKDVKKNNQKVNLE<br>SNYIQNIKFIVS |
| WP_062627846 | MEKERRQNRNSIIKIIISNYDTKGIKELKVRYRKQAQLDTFIIKTEIVNN<br>DIFIKSIIEKAREKYRYSFLEDGEEKYHFKNKSSVEIVKKDIFSQTPDNM<br>IRNYKITLKISEKNPRVVEAEIEDLMNSTILKDGRRSARREKSVTERKLI<br>EEKVAENYSLLANCPMEEVDSIKIYKIKRELTYRSNMLLYEASINSFLCE<br>GIKGKENETEEIWHLKDNDVRKEKVKENFKNKLIQSTENYNSSLKNQIEE<br>KEKLLRKESKKGAFYRTIIKKLQQERIKELSEKSLTEDCEKIIKLYSKLR<br>HSLMHYDYQYFENLEENKETPELKDKLDLHLEKSLPLIRKMKLNNKVNYL<br>EDGDTLFVLQKTKKAKTLYQIYDALCEQKNGENKEINDEFVSDGEENTVF<br>KQIIINEKFQSEMEFLGKRISESEEKNPKLKKKFDSMKAHFHNINSEDTKE<br>AYFWDIHSSSNYKTKYNERKNLVNEYTELLGSSKEKKLLREEITQINRKL<br>LKLKQEMEEITKKNSLERLEYKMKMAFGELECEFDGNISREKDEFDASNQ<br>EKIIQYHKNGEKYLTYELKEEEKEKENLKKLQETIQKTGKENWLLPQNKN<br>NLFKFYLLTYLLLPYELKGDFLGEVKKHYYDIKNVDFMDENQSSKIIESK<br>EDDEYHKIRLFEKNTKKYEIVKYSIVPDEKLKQYFKDLGIDTKYLILEQK<br>SEVSGEKNKKVSLKNNGMENKTILLEVEKYYQIAFKLENDIELYSLEFLR<br>EKSGKPFEVFLKELKDKMIGKQLNFGQLLYVIYEVLVKNKDLSEILSERI<br>DYRKDMCFSAEIADLRNFLSHLNYSKFLDNFMKINTNKSDENKEVLIPSI<br>KIQKMIKFIEECNLQSQIDEDENEVNDEYMRKEKMFFIQLKQIEPDINST<br>EKQKMNEKEEILRNRYHLTDKKNEQIKDEHEAQSQLYEKILSLQKIYSSD<br>KNNFYGRLKEEKLLFLGKQGKKKLSMEEIKDKIAGDISDLLGILKKEITR<br>DIKDKLTEKFRYCEEKLLNLSFYNHQDKKKEESIRVFLIRDKNSDNEKEE<br>SILDDGSNKIFISKNGKEITIQCCDKVLETLMIEKNTLKISSNGKIISLV<br>PHYSYSIDVKY |
| WP_005959231 | MEKERRQNRNSIIKIIISNYDTKGIKELKVRYRKQAQLDTFIIKTEIVNN<br>DIFIKSIIEKAREKYRYSFLEDGEEKYHFKNKSSVEIVKKDIFSQTPDNM<br>IRNYKITLKISEKNPRVVEAEIEDLMNSTILKDGRRSARREKSMTERKLI<br>EEKVAKNYSLLANCPMEEVDSIKIYKIKRELTYRSNMLLYEASINSFLCE<br>GIKGKDNETEEIWHLKDNDVRKEKVRENEKNKLIQSTENYNSSLKNQIEE<br>KEKLLRKEFKKGAFYRTIIKKLQQERIKELSEKSLTEDCEKIIKLYSKLR<br>HSLMHYDYQYFENLEENKKNDDLMKDLNLDLEKSLPLIRKMKLNNKVNYL<br>EDGDTLFVLQKTKKAKTLYQIYDALCEQKNGENKEINDEFVSDGEENTVF<br>KQIIINEKFQSEMEFLEKRISESEKKNEKLKKKLDSMKAHFRNINSEDTKE<br>AYFWDIHSSRNYKTKYNERKNLVNEYTELLGSSKEKKLLREEITKINRQL<br>LKLKQEMEEITKKNSLERLEYKMKIAFGELECEFDGNISKEKDEFDASNQ<br>EKIIQYHKNGEKYLTSELKEEEKEKENLEKMQKIIQKTEEEDWLLPETKN<br>NLEKEYLLTYLLLPYELKGDFLGFVKKHYYDIKNVDFIDENQNNIQVSQT<br>VEKQEDYFHKIRLFEKNTKKYEIVKYSIVPNEKLKQYFEDLGIDIKYLT<br>VEQKSEVSEEKNKKVSLKNNGMENKTILLEVEKYYQIAFKLENDIELYSL<br>EFLREKSGKPLEIFRKELESKMKDGYLNFGQLLYVVYEVLVKNKDLDKIL<br>SKKIDYRKDKSFSPEIAYLRNELSHLNYSKFLDNFMKINTNKSDENKEVL<br>IPSIKIQKMIQFIEKCNLQNQIDEDENEVNDEYMRKEKMEEIQLKQIFPD<br>INSTEKQKMNEKEEILRNRYHLTDKKNEQIKDEHEAQSQLYEKILSLQKI<br>YSSDKNNFYGRLKEEKLLFLEKQGKKKLSMEEIKDKIAGDISDLLGILKK<br>EITRDIKDKLTEKFRYCEEKLLNLSFYNHQDKKKEESIRVFLIRDKNSDN<br>EKEESILDDGSNKIFISKNGKEITIQCCDKVLETLIIEKNTLKISSNGKI<br>ISLIPHYSYSIDVKY |
| WP_027128616 | MGKPNRSSIIKIIISNYDNKGIKEVKVRYNKQAQLDTFLIKSELKDGKFI<br>LYSIVDKAREKYRYSFEIDKTNINKNEILIIKKDIYSNKEDKVIRKYILS<br>FEVSEKNDRTIVTKIKDCLETQKKEKFERENTRRLISETERKLLSEETQK<br>TYSKIACCSPEDIDSVKIYKIKRYLAYRSNMLLFFSLINDIFVKGVVKDN<br>GEEVGEIWRIIDSKEIDEKKTYDLLVENFKKRMSQEFINYKQSIENKIEK<br>NTNKIKEIEQKLKKEKYKKEINRLKKQLIELNRENDLLEKDKIELSDEEI<br>REDIEKILKIYSDLRHKLMHYNYQYFENLEENKKISKEKNEDVNLTELLD<br>LNLERYLPLVRQLKLENKTNYLEKEDKITVLGVSDSAIKYYSYYNELCEQ<br>KNGENNFINSFESNDGEENKSFKEKINLSLEKEIEIMEKETNEKIKEINK<br>NELQLMKEQKELGTAYVLDIHSLNDYKISHNERNKNVKLQNDIMNGNRDK<br>NALDKINKKLVELKIKMDKITKRNSILRLKYKLQVAYGELMEEYKGNIKK<br>EKDEFDISKEKIKSYKSKGEKYLEVKSEKKYITKILNSIEDIHNITWLKN<br>QEENNLEKEYVLTYILLPFEERGDELGEVKKHYYDIKNVEFLDENNDRLT<br>PEQLEKMKNDSEENKIRLEEKNSKKYDILKESILTSERIGKYFSLLNTGA<br>KYFEYGGEENRGIENKNIIIPIFKYYQIVLKLYNDVELAMLLTLSESDEK |

TABLE 4B-continued

| Name | Sequence |
|---|---|
| | DINKIKELVTLKEKVSPKKIDYEKKYKFSVLLDCENRIINLGKKDELASE<br>EVKEVAKTETNLAYLRNKICHLNYSKFIDDLLTIDTNKSTTDSEGKLLIN<br>DRIRKLIKFIRENNQKMNISIDYNYINDYYMKKEKFIFGQRKQAKTIIDS<br>GKKANKRNKAEELLKMYRVKKENINLIYELSKKLNELTKSELFLLDKKLL<br>KDIDFTDVKIKNKSEFELKNDVKEVANIKQALQKHSSELIGIYKKEVIMA<br>IKRSIVSKLIYDEEKVLSIIIYDKTNKKYEDELLEIRRERDINKEQFLID<br>EKKEKLGYEKIIETKEKKKVVVKIQNNSELVSEPRIIKNKDKKKAKTPEE<br>ISKLGILDLTNHYCFNLKITL |
| WP_062624740 | MEKERRQNRNSIIKIIISNYDTKGIKELKVRYRKQAQLDTFIIKTEIVNN<br>DIFIKSIIEKAREKYRYSFLEDGEEKYHFKNKSSVEIVKKDIFSQTPDNM<br>IRNYKITLKISEKNPRVVEAEIEDLMNSTILKDGRRSARREKSMTERKLI<br>EEKVAKNYSLLANCPMEEVDSIKIYKIKRELTYRSNMLLYEASINSFLCE<br>GIKGKDNETEEIWHLKDNDVRKEKVRENEKNKLIQSTENYNSSLKNQIEE<br>KEKLLRKEFKKGAFYRTIIKKLQQERIKELSEKSLTEDCEKIIKLYSKLR<br>HSLMHYDYQYFENLEENKKNDDLMKDLNLDLEKSLPLIRKMKLNNKVNYL<br>EDGDTLFVLQKTKKAKTLYQIYDALCEQKNGENKEINDEFVSDGEENTVF<br>KQIINEKFQSEMEFLEKRISESEKKNEKLKKKLDSMKAHFRNINSEDTKE<br>AYFWDIHSSRNYKTKYNERKNLVNEYTELLGSSKEKKLLREEITKINRQL<br>LKLKQEMEEITKKNSLERLEYKMKIAFGELECEFDGNISKEKDEFDASNQ<br>EKIIQYHKNGEKYLTSELKEEEKEKENLEKMQKIIQKTEEEDWLLPETKN<br>NLEKEYLLTYLLLPYELKGDFLGFVKKHYYDIKNVDFIDENQNNIQVSQT<br>VEKQEDYFYHKIRLFEKNTKKYEIVKYSIVPNEKLKQYFEDLGIDIKYLT<br>GSVESGEKWLGENLGIDIKYLTVEQKSEVSEEKNKKVSLKNNGMFNKTIL<br>LEVEKYYQIAFKLENDIELYSLEFLREKSGKPLEIFRKELESKMKDGYLN<br>FGQLLYVVYEVLVKNKDLDKILSKKIDYRKDKSFSPEIAYLRNELSHLNY<br>SKFLDNFMKINTNKSDENKEVLIPSIKIQKMIQFIEKCNLQNQIDEDENE<br>VNDEYMRKEKMEFIQLKQIEPDINSTEKQKMNEKEEILRNRYHLTDKKNE<br>QIKDEHEAQSQLYEKILSLQKIYSSDKNNFYGRLKEEKLLFLEKQGKKKL<br>SMEEIKDKIAGDISDLLGILKKEITRDIKDKLTEKFRYCEEKLLNLSFYN<br>HQDKKKEESIRVELIRDKNSDNEKEESILDDGSNKIFISKNGKEITIQCC<br>DKVLETLIIEKNTLKISSNGKIISLIPHYSYSIDVKY |
| WP_096402050 | MENKNKPNRGSIVRIIISNYDMKGIKELKVRYRKQAQLDTFILQTTLDKS<br>NNSILINDFRVKAREKYRYSFTYDGKEKFSVPSNSIIVTKIDNAAPEKSK<br>EIRKYKITLGIDEKCKTGSMITAAIEDLLEDDRVREGIRNPRRKASKTER<br>KLITESICHNYAQITQCPVEEIDAVKIYKVKRFLSYRSNMLLFFALINDF<br>LCKNLKNEKGEKINEIWEMENKGNNKKIDEDENYNILVAQIKEYETKEIE<br>NYNNRIDNIIDKKELLKYSEEKEESEKNKKLEELNKLESQKLKILTDEEI<br>KADVIKIIKIFSDLRHSLMHYEYKYFENLEENKKNEELAELLNLNLEKNL<br>TLLRQMKIENKTNYLEGDEKENILGKDVRAKNALGHYDLLVEQKNGENNE<br>INSFEVQDGTENLEEKKEIDENFIKAQKELEEDIKNCKESVKKLEKKLKE<br>NPKKSEDLEKKLEKKQKKLKELKKELEKMKQHYKRLNCAYVWDIHSSTVY<br>KKLYNERKNLIEKYNKQLNGLQDKNAITGINAQLLRIKKEMEEITKSNSL<br>FRLKYKMQIAYAFLEMEYEGNIAKFKNEFDCSKTEKIQEWLEKSEEYLNY<br>CMEKEEDGKNYKFHPKEISEIKDTHNEEWLENTSENNLFKFYILTYLLLP<br>MEEKGDFLGVVKKHYYDIKNVDFTDESEKELSQEQIDKMIGDSFFHKIRL<br>FEKNTKRYEIIKYSILTSDEIKKYFELLELKVPYLEYKGIDEIGIENKNI<br>ILPIFKYYQIIERLYNDLEIHGLENVSFDINKILSDLKSYGNENINFREF<br>LYVIKQNNNSSTEEEYQKIWEKLESKYLKEPLLTPEKKEINKKTEKELKK<br>LDGISFLRNKISHLEYEKIIEGVLKTAVNGENKKTSETNADKVFLNEKIK<br>KIINFIKENELDKIELGENFINDEFMKKEQEMEGQIKQVKEGNSDSITTE<br>RKRKEENNKRLKITYGLNYNNLSKIYEFSNTLREIVNSPLFLKDSTLLKK<br>VDLSKVMLKEKPICSLQYENNTKLEDDIKRILLKDSSDIMGIYKAEVVKK<br>LKEKLVLIFKYDEEKKIYVTVYDTSKAVPENISKEILVKRNNSKEEYFFE<br>DNKKKYTTQYYTLEITKENELKVIPAKKLEGKEFKTEKKEENKLMLNNHY<br>CFNVKIIY |

In some embodiments, the components of the AD-functionalized CRISPR-Cas system may be delivered in various form, such as combinations of DNA/RNA or RNA/RNA or protein RNA. For example, the Cas13 protein may be delivered as a DNA-coding polynucleotide or an RNA-coding polynucleotide or as a protein. The guide may be delivered may be delivered as a DNA-coding polynucleotide or an RNA. All possible combinations are envisioned, including mixed forms of delivery.

In some aspects, the invention provides methods comprising delivering one or more polynucleotides, such as or one or more vectors as described herein, one or more transcripts thereof, and/or one or proteins transcribed therefrom, to a host cell.

Vectors

In general, the term "vector" refers to a nucleic acid molecule capable of transporting another nucleic acid to which it has been linked. It is a replicon, such as a plasmid, phage, or cosmid, into which another DNA segment may be inserted so as to bring about the replication of the inserted segment. Generally, a vector is capable of replication when associated with the proper control elements Vectors include, but are not limited to, nucleic acid molecules that are single-stranded, double-stranded, or partially double-stranded; nucleic acid molecules that comprise one or more free ends, no free ends (e.g., circular); nucleic acid molecules that comprise DNA, RNA, or both; and other varieties of polynucleotides known in the art. One type of vector is a "plasmid," which refers to a circular double stranded DNA loop into which additional DNA segments can be inserted, such as by standard molecular cloning techniques. Another type of vector is a viral vector, wherein virally-derived DNA or RNA sequences are present in the vector for packaging into a virus (e.g., retroviruses, replication defective retroviruses, adenoviruses, replication defective adenoviruses, and adeno-associated viruses). Viral vectors also include polynucleotides carried by a virus for transfection into a host cell. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively-linked. Such vectors are referred to herein as "expression vectors." Vectors for and that result in expression in a eukaryotic cell can be referred to herein as "eukaryotic expression vectors." Common expression vectors of utility in recombinant DNA techniques are often in the form of plasmids.

Recombinant expression vectors can comprise a nucleic acid of the invention in a form suitable for expression of the nucleic acid in a host cell, which means that the recombinant expression vectors include one or more regulatory elements, which may be selected on the basis of the host cells to be used for expression, that is operatively-linked to the nucleic acid sequence to be expressed. Within a recombinant expression vector, "operably linked" is intended to mean that the nucleotide sequence of interest is linked to the regulatory element(s) in a manner that allows for expression of the nucleotide sequence (e.g., in an in vitro transcription/translation system or in a host cell when the vector is introduced into the host cell). Advantageous vectors include lentiviruses and adeno-associated viruses, and types of such vectors can also be selected for targeting particular types of cells.

With regards to recombination and cloning methods, mention is made of U.S. patent application Ser. No. 10/815,730, published Sep. 2, 2004 as US 2004-0171156 A1, the contents of which are herein incorporated by reference in their entirety.

The term "regulatory element" is intended to include promoters, enhancers, internal ribosomal entry sites (IRES), and other expression control elements (e.g., transcription termination signals, such as polyadenylation signals and poly-U sequences). Such regulatory elements are described, for example, in Goeddel, GENE EXPRESSION TECHNOLOGY: METHODS IN ENZYMOLOGY 185, Academic Press, San Diego, Calif (1990). Regulatory elements include those that direct constitutive expression of a nucleotide sequence in many types of host cell and those that direct expression of the nucleotide sequence only in certain host cells (e.g., tissue-specific regulatory sequences). A tissue-specific promoter may direct expression primarily in a desired tissue of interest, such as muscle, neuron, bone, skin, blood, specific organs (e.g., liver, pancreas), or particular cell types (e.g., lymphocytes). Regulatory elements may also direct expression in a temporal-dependent manner, such as in a cell-cycle dependent or developmental stage-dependent manner, which may or may not also be tissue or cell-type specific. In some embodiments, a vector comprises one or more pol III promoter (e.g., 1, 2, 3, 4, 5, or more pol III promoters), one or more pol II promoters (e.g., 1, 2, 3, 4, 5, or more pol II promoters), one or more pol I promoters (e.g., 1, 2, 3, 4, 5, or more pol I promoters), or combinations thereof. Examples of pol III promoters include, but are not limited to, U6 and H1 promoters. Examples of pol II promoters include, but are not limited to, the retroviral Rous sarcoma virus (RSV) LTR promoter (optionally with the RSV enhancer), the cytomegalovirus (CMV) promoter (optionally with the CMV enhancer) [see, e.g., Boshart et al, Cell, 41:521-530 (1985)], the SV40 promoter, the dihydrofolate reductase promoter, the β-actin promoter, the phosphoglycerol kinase (PGK) promoter, and the EF1α promoter. Also encompassed by the term "regulatory element" are enhancer elements, such as WPRE; CMV enhancers; the R-U5' segment in LTR of HTLV-I (Mol. Cell. Biol., Vol. 8(1), p. 466-472, 1988); SV40 enhancer; and the intron sequence between exons 2 and 3 of rabbit β-globin (Proc. Natl. Acad. Sci. USA., Vol. 78(3), p. 1527-31, 1981). It will be appreciated by those skilled in the art that the design of the expression vector can depend on such factors as the choice of the host cell to be transformed, the level of expression desired, etc. A vector can be introduced into host cells to thereby produce transcripts, proteins, or peptides, including fusion proteins or peptides, encoded by nucleic acids as described herein (e.g., clustered regularly interspersed short palindromic repeats (CRISPR) transcripts, proteins, enzymes, mutant forms thereof, fusion proteins thereof, etc.). With regards to regulatory sequences, mention is made of U.S. patent application Ser. No. 10/491,026, the contents of which are incorporated by reference herein in their entirety. With regards to promoters, mention is made of PCT publication WO 2011/028929 and U.S. application Ser. No. 12/511,940, the contents of which are incorporated by reference herein in their entirety.

Advantageous vectors include lentiviruses and adeno-associated viruses, and types of such vectors can also be selected for targeting particular types of cells.

In particular embodiments, use is made of bicistronic vectors for the guide RNA and (optionally modified or mutated) the CRISPR-Cas protein fused to adenosine deaminase. Bicistronic expression vectors for guide RNA and (optionally modified or mutated) CRISPR-Cas protein fused to adenosine deaminase are preferred. In general and particularly in this embodiment, (optionally modified or mutated) CRISPR-Cas protein fused to adenosine deaminase is preferably driven by the CBh promoter. The RNA may preferably be driven by a Pol III promoter, such as a U6 promoter. Ideally the two are combined.

Vectors can be designed for expression of CRISPR transcripts (e.g. nucleic acid transcripts, proteins, or enzymes) in prokaryotic or eukaryotic cells. For example, CRISPR transcripts can be expressed in bacterial cells such as *Escherichia coli*, insect cells (using baculovirus expression vectors), yeast cells, or mammalian cells. Suitable host cells are discussed further in Goeddel, GENE EXPRESSION TECHNOLOGY: METHODS IN ENZYMOLOGY 185, Academic Press, San Diego, Calif. (1990). Alternatively, the recombinant expression vector can be transcribed and translated in vitro, for example using T7 promoter regulatory sequences and T7 polymerase.

Vectors may be introduced and propagated in a prokaryote or prokaryotic cell. In some embodiments, a prokaryote is used to amplify copies of a vector to be introduced into a eukaryotic cell or as an intermediate vector in the production of a vector to be introduced into a eukaryotic cell (e.g. amplifying a plasmid as part of a viral vector packaging system). In some embodiments, a prokaryote is used to amplify copies of a vector and express one or more nucleic acids, such as to provide a source of one or more proteins for delivery to a host cell or host organism. Expression of proteins in prokaryotes is most often carried out in *Escheri-* chia coli with vectors containing constitutive or inducible promoters directing the expression of either fusion or non-fusion proteins. Fusion vectors add a number of amino acids to a protein encoded therein, such as to the amino terminus of the recombinant protein. Such fusion vectors may serve one or more purposes, such as: (i) to increase expression of recombinant protein; (ii) to increase the solubility of the recombinant protein; and (iii) to aid in the purification of the recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase. Example fusion expression vectors include pGEX (Pharmacia Biotech Inc; Smith and Johnson, 1988. Gene 67: 31-40), pMAL (New England Biolabs, Beverly, Mass.) and pRIT5 (Pharmacia, Piscataway, N.J.) that fuse glutathione S-transferase (GST), maltose E binding protein, or protein A, respectively, to the target recombinant protein. Examples of suitable inducible non-fusion E. coli expression vectors include pTrc (Amrann et al., (1988) Gene 69:301-315) and pET 11d (Studier et al., GENE EXPRESSION TECHNOLOGY: METHODS IN ENZYMOLOGY 185, Academic Press, San Diego, Calif. (1990) 60-89). In some embodiments, a vector is a yeast expression vector. Examples of vectors for expression in yeast *Saccharomyces cerevisiae* include pYepSec1 (Baldari, et al., 1987. EMBO J. 6: 229-234), pMFa (Kuijan and Herskowitz, 1982. Cell 30: 933-943), pJRY88 (Schultz et al., 1987. Gene 54: 113-123), pYES2 (Invitrogen Corporation, San Diego, Calif.), and picZ (InVitrogen Corp, San Diego, Calif.). In some embodiments, a vector drives protein expression in insect cells using baculovirus expression vectors. Baculovirus vectors available for expression of proteins in cultured insect cells (e.g., SF9 cells) include the pAc series (Smith, et al., 1983. Mol. Cell. Biol. 3: 2156-2165) and the pVL series (Luckow and Summers, 1989. Virology 170: 31-39).

In some embodiments, a vector is capable of driving expression of one or more sequences in mammalian cells using a mammalian expression vector. Examples of mammalian expression vectors include pCDM8 (Seed, 1987. Nature 329: 840) and pMT2PC (Kaufman, et al., 1987. EMBO J. 6: 187-195). When used in mammalian cells, the expression vector's control functions are typically provided by one or more regulatory elements. For example, commonly used promoters are derived from polyoma, adenovirus 2, cytomegalovirus, simian virus 40, and others disclosed herein and known in the art. For other suitable expression systems for both prokaryotic and eukaryotic cells see, e.g., Chapters 16 and 17 of Sambrook, et al., MOLECULAR CLONING: A LABORATORY MANUAL. 2nd ed., Cold Spring Harbor Laboratory, Cold Spring Harbor Laboratory Press, Cold Spring Harbor, N.Y., 1989.

In some embodiments, the recombinant mammalian expression vector is capable of directing expression of the nucleic acid preferentially in a particular cell type (e.g., tissue-specific regulatory elements are used to express the nucleic acid). Tissue-specific regulatory elements are known in the art. Non-limiting examples of suitable tissue-specific promoters include the albumin promoter (liver-specific; Pinkert, et al., 1987. Genes Dev. 1: 268-277), lymphoid-specific promoters (Calame and Eaton, 1988. Adv. Immunol. 43: 235-275), in particular promoters of T cell receptors (Winoto and Baltimore, 1989. EMBO J. 8: 729-733) and immunoglobulins (Baneiji, et al., 1983. Cell 33: 729-740; Queen and Baltimore, 1983. Cell 33: 741-748), neuron-specific promoters (e.g., the neurofilament promoter; Byrne and Ruddle, 1989. Proc. Natl. Acad. Sci. USA 86: 5473-5477), pancreas-specific promoters (Edlund, et al., 1985. Science 230: 912-916), and mammary gland-specific promoters (e.g., milk whey promoter; U.S. Pat. No. 4,873,316 and European Application Publication No. 264,166). Developmentally-regulated promoters are also encompassed, e.g., the murine hox promoters (Kessel and Gruss, 1990. Science 249: 374-379) and the α-fetoprotein promoter (Campes and Tilghman, 1989. Genes Dev. 3: 537-546). With regards to these prokaryotic and eukaryotic vectors, mention is made of U.S. Pat. No. 6,750,059, the contents of which are incorporated by reference herein in their entirety. Other embodiments of the invention may relate to the use of viral vectors, with regards to which mention is made of U.S. patent application Ser. No. 13/092,085, the contents of which are incorporated by reference herein in their entirety. Tissue-specific regulatory elements are known in the art and in this regard, mention is made of U.S. Pat. No. 7,776,321, the contents of which are incorporated by reference herein in their entirety. In some embodiments, a regulatory element is operably linked to one or more elements of a CRISPR system so as to drive expression of the one or more elements of the CRISPR system.

In some embodiments, one or more vectors driving expression of one or more elements of a nucleic acid-targeting system are introduced into a host cell such that expression of the elements of the nucleic acid-targeting system direct formation of a nucleic acid-targeting complex at one or more target sites. For example, a nucleic acid-targeting effector enzyme and a nucleic acid-targeting guide RNA could each be operably linked to separate regulatory elements on separate vectors. RNA(s) of the nucleic acid-targeting system can be delivered to a transgenic nucleic acid-targeting effector protein animal or mammal, e.g., an animal or mammal that constitutively or inducibly or conditionally expresses nucleic acid-targeting effector protein; or an animal or mammal that is otherwise expressing nucleic acid-targeting effector proteins or has cells containing nucleic acid-targeting effector proteins, such as by way of prior administration thereto of a vector or vectors that code for and express in vivo nucleic acid-targeting effector proteins. Alternatively, two or more of the elements expressed from the same or different regulatory elements, may be combined in a single vector, with one or more additional vectors providing any components of the nucleic acid-targeting system not included in the first vector. nucleic acid-targeting system elements that are combined in a single vector may be arranged in any suitable orientation, such as one element located 5' with respect to ("upstream" of) or 3' with respect to ("downstream" of) a second element. The coding sequence of one element may be located on the same or opposite strand of the coding sequence of a second element, and oriented in the same or opposite direction. In some embodiments, a single promoter drives expression of a transcript encoding a nucleic acid-targeting effector protein and the nucleic acid-targeting guide RNA, embedded within one or more intron sequences (e.g., each in a different intron, two or more in at least one intron, or all in a single intron). In some embodiments, the nucleic acid-targeting effector protein and the nucleic acid-targeting guide RNA may be operably linked to and expressed from the same promoter. Delivery vehicles, vectors, particles, nanoparticles, formulations and components thereof for expression of one or more elements of a nucleic acid-targeting system are as used in the foregoing documents, such as WO 2014/093622 (PCT/US2013/074667). In some embodiments, a vector comprises one or more insertion sites, such as a restriction endonuclease recognition sequence (also referred to as a "cloning site"). In some embodiments, one or more insertion sites (e.g., about or more than about 1, 2, 3, 4, 5, 6, 7, 8, 9, 10, or more insertion sites) are located upstream and/or downstream of one or more sequence elements of one or more vectors. When multiple different guide sequences are used, a single expression construct may be used to target nucleic acid-targeting activity to multiple different, corresponding target sequences within a cell. For example, a single vector may comprise about or more than about 1, 2, 3, 4, 5, 6, 7, 8, 9, 10, 15, 20, or more guide sequences. In some embodiments, about or more than about 1, 2, 3, 4, 5, 6, 7, 8, 9, 10, or more such guide—sequence-containing vectors may be provided, and optionally delivered to a cell. In some embodiments, a vector comprises a regulatory element operably linked to an enzyme-coding sequence encoding a nucleic acid-targeting effector protein. Nucleic acid-targeting effector protein or nucleic acid-targeting guide RNA or RNA(s) can be delivered separately; and advantageously at least one of these is delivered via a particle complex. nucleic acid-targeting effector protein mRNA can be delivered prior to the nucleic acid-targeting guide RNA to give time for nucleic acid-targeting effector protein to be expressed. Nucleic acid-targeting effector protein mRNA might be administered 1-12 hours (preferably around 2-6 hours) prior to the administration of nucleic acid-targeting guide RNA. Alternatively, nucleic acid-targeting effector protein mRNA and nucleic acid-targeting guide RNA can be administered together. Advantageously, a second booster dose of guide RNA can be administered 1-12 hours (preferably around 2-6 hours) after the initial administration of nucleic acid-targeting effector protein mRNA+ guide RNA. Additional administrations of nucleic acid-targeting effector protein mRNA and/or guide RNA might be useful to achieve the most efficient levels of genome modification.

Conventional viral and non-viral based gene transfer methods can be used to introduce nucleic acids in mammalian cells or target tissues. Such methods can be used to administer nucleic acids encoding components of a nucleic acid-targeting system to cells in culture, or in a host organism. Non-viral vector delivery systems include DNA plasmids, RNA (e.g. a transcript of a vector described herein), naked nucleic acid, and nucleic acid complexed with a delivery vehicle, such as a liposome. Viral vector delivery systems include DNA and RNA viruses, which have either episomal or integrated genomes after delivery to the cell. For a review of gene therapy procedures, see Anderson, Science 256:808-813 (1992); Nabel & Felgner, TIBTECH 11:211-217 (1993); Mitani & Caskey, TIBTECH 11:162-166 (1993); Dillon, TIBTECH 11:167-175 (1993); Miller, Nature 357:455-460 (1992); Van Brunt, Biotechnology 6(10):1149-1154 (1988); Vigne, Restorative Neurology and Neuroscience 8:35-36 (1995); Kremer & Perricaudet, British Medical Bulletin 51(1):31-44 (1995); Haddada et al., in Current Topics in Microbiology and Immunology, Doerfler and Böhm (eds) (1995); and Yu et al., Gene Therapy 1:13-26 (1994).

Methods of non-viral delivery of nucleic acids include lipofection, nucleofection, microinjection, biolistics, virosomes, liposomes, immunoliposomes, polycation or lipid:nucleic acid conjugates, naked DNA, artificial virions, and agent-enhanced uptake of DNA. Lipofection is described in e.g., U.S. Pat. Nos. 5,049,386, 4,946,787; and 4,897,355) and lipofection reagents are sold commercially (e.g., Transfectam™ and Lipofectin™). Cationic and neutral lipids that are suitable for efficient receptor-recognition lipofection of polynucleotides include those of Felgner, WO 91/17424; WO 91/16024. Delivery can be to cells (e.g. in vitro or ex vivo administration) or target tissues (e.g. in vivo administration).

Plasmid delivery involves the cloning of a guide RNA into a CRISPR-Cas protein expressing plasmid and transfecting the DNA in cell culture. Plasmid backbones are available commercially and no specific equipment is required. They have the advantage of being modular, capable of carrying different sizes of CRISPR-Cas coding sequences (including those encoding larger sized proteins) as well as selection markers. Both an advantage of plasmids is that they can ensure transient, but sustained expression. However, delivery of plasmids is not straightforward such that in vivo efficiency is often low. The sustained expression can also be disadvantageous in that it can increase off-target editing. In addition excess build-up of the CRISPR-Cas protein can be toxic to the cells. Finally, plasmids always hold the risk of random integration of the dsDNA in the host genome, more particularly in view of the double-stranded breaks being generated (on and off-target).

The preparation of lipid:nucleic acid complexes, including targeted liposomes such as immunolipid complexes, is well known to one of skill in the art (see, e.g., Crystal, Science 270:404-410 (1995); Blaese et al., Cancer Gene Ther. 2:291-297 (1995); Behr et al., Bioconjugate Chem. 5:382-389 (1994); Remy et al., Bioconjugate Chem. 5:647-654 (1994); Gao et al., Gene Therapy 2:710-722 (1995); Ahmad et al., Cancer Res. 52:4817-4820 (1992); U.S. Pat. Nos. 4,186,183, 4,217,344, 4,235,871, 4,261,975, 4,485,054, 4,501,728, 4,774,085, 4,837,028, and 4,946,787). This is discussed more in detail below.

The use of RNA or DNA viral based systems for the delivery of nucleic acids takes advantage of highly evolved processes for targeting a virus to specific cells in the body and trafficking the viral payload to the nucleus. Viral vectors can be administered directly to patients (in vivo) or they can be used to treat cells in vitro, and the modified cells may optionally be administered to patients (ex vivo). Conventional viral based systems could include retroviral, lentivirus, adenoviral, adeno-associated and herpes simplex virus vectors for gene transfer. Integration in the host genome is possible with the retrovirus, lentivirus, and adeno-associated virus gene transfer methods, often resulting in long term expression of the inserted transgene. Additionally, high transduction efficiencies have been observed in many different cell types and target tissues.

The tropism of a retrovirus can be altered by incorporating foreign envelope proteins, expanding the potential target population of target cells. Lentiviral vectors are retroviral vectors that are able to transduce or infect non-dividing cells and typically produce high viral titers. Selection of a retroviral gene transfer system would therefore depend on the target tissue. Retroviral vectors are comprised of cis-acting long terminal repeats with packaging capacity for up to 6-10 kb of foreign sequence. The minimum cis-acting LTRs are sufficient for replication and packaging of the vectors, which are then used to integrate the therapeutic gene into the target cell to provide permanent transgene expression. Widely used retroviral vectors include those based upon murine leukemia virus (MuLV), gibbon ape leukemia virus (GaLV), Simian Immuno deficiency virus (SIV), human immuno deficiency virus (HIV), and combinations thereof (see, e.g., Buchscher et al., J. Virol. 66:2731-2739 (1992); Johann et al., J. Virol. 66:1635-1640 (1992); Sommnerfelt et al., Virol. 176:58-59

(1990); Wilson et al., J. Virol. 63:2374-2378 (1989); Miller et al., J. Virol. 65:2220-2224 (1991); PCT/US94/05700).

In applications where transient expression is preferred, adenoviral based systems may be used. Adenoviral based vectors are capable of very high transduction efficiency in many cell types and do not require cell division. With such vectors, high titer and levels of expression have been obtained. This vector can be produced in large quantities in a relatively simple system. Adeno-associated virus ("AAV") vectors may also be used to transduce cells with target nucleic acids, e.g., in the in vitro production of nucleic acids and peptides, and for in vivo and ex vivo gene therapy procedures (see, e.g., West et al., Virology 160:38-47 (1987); U.S. Pat. No. 4,797,368; WO 93/24641; Kotin, Human Gene Therapy 5:793-801 (1994); Muzyczka, J. Clin. Invest. 94:1351 (1994). Construction of recombinant AAV vectors are described in a number of publications, including U.S. Pat. No. 5,173,414; Tratschin et al., Mol. Cell. Biol. 5:3251-3260 (1985); Tratschin, et al., Mol. Cell. Biol. 4:2072-2081 (1984); Hermonat & Muzyczka, PNAS 81:6466-6470 (1984); and Samulski et al., J. Virol. 63:03822-3828 (1989).

The invention provides AAV that contains or consists essentially of an exogenous nucleic acid molecule encoding a CRISPR system, e.g., a plurality of cassettes comprising or consisting a first cassette comprising or consisting essentially of a promoter, a nucleic acid molecule encoding a CRISPR-associated (Cas) protein (putative nuclease or helicase proteins), e.g., Cas13 and a terminator, and one or more, advantageously up to the packaging size limit of the vector, e.g., in total (including the first cassette) five, cassettes comprising or consisting essentially of a promoter, nucleic acid molecule encoding guide RNA (gRNA) and a terminator (e.g., each cassette schematically represented as Promoter-gRNA1-terminator, Promoter-gRNA2-terminator . . . Promoter-gRNA(N)-terminator, where N is a number that can be inserted that is at an upper limit of the packaging size limit of the vector), or two or more individual rAAVs, each containing one or more than one cassette of a CRISPR system, e.g., a first rAAV containing the first cassette comprising or consisting essentially of a promoter, a nucleic acid molecule encoding Cas, e.g., Cas (Cas13) and a terminator, and a second rAAV containing one or more cassettes each comprising or consisting essentially of a promoter, nucleic acid molecule encoding guide RNA (gRNA) and a terminator (e.g., each cassette schematically represented as Promoter-gRNA1-terminator, Promoter-gRNA2-terminator . . . Promoter-gRNA(N)-terminator, where N is a number that can be inserted that is at an upper limit of the packaging size limit of the vector). Alternatively, because Cas13 can process its own crRNA/gRNA, a single crRNA/gRNA array can be used for multiplex gene editing. Hence, instead of including multiple cassettes to deliver the gRNAs, the rAAV may contain a single cassette comprising or consisting essentially of a promoter, a plurality of crRNA/gRNA, and a terminator (e.g., schematically represented as Promoter-gRNA1-gRNA2 . . . gRNA(N)-terminator, where N is a number that can be inserted that is at an upper limit of the packaging size limit of the vector). See Zetsche et al Nature Biotechnology 35, 31-34 (2017), which is incorporated herein by reference in its entirety. As rAAV is a DNA virus, the nucleic acid molecules in the herein discussion concerning AAV or rAAV are advantageously DNA. The promoter is in some embodiments advantageously human Synapsin I promoter (hSyn). Additional methods for the delivery of nucleic acids to cells are known to those skilled in the art. See, for example, US20030087817, incorporated herein by reference.

In another embodiment, Cocal vesiculovirus envelope pseudotyped retroviral vector particles are contemplated (see, e.g., US Patent Publication No. 20120164118 assigned to the Fred Hutchinson Cancer Research Center). Cocal virus is in the Vesiculovirus genus, and is a causative agent of vesicular stomatitis in mammals. Cocal virus was originally isolated from mites in Trinidad (Jonkers et al., Am. J. Vet. Res. 25:236-242 (1964)), and infections have been identified in Trinidad, Brazil, and Argentina from insects, cattle, and horses. Many of the vesiculoviruses that infect mammals have been isolated from naturally infected arthropods, suggesting that they are vector-borne. Antibodies to vesiculoviruses are common among people living in rural areas where the viruses are endemic and laboratory-acquired; infections in humans usually result in influenza-like symptoms. The Cocal virus envelope glycoprotein shares 71.5% identity at the amino acid level with VSV-G Indiana, and phylogenetic comparison of the envelope gene of vesiculoviruses shows that Cocal virus is serologically distinct from, but most closely related to, VSV-G Indiana strains among the vesiculoviruses. Jonkers et al., Am. J. Vet. Res. 25:236-242 (1964) and Travassos da Rosa et al., Am. J. Tropical Med. & Hygiene 33:999-1006 (1984). The Cocal vesiculovirus envelope pseudotyped retroviral vector particles may include for example, lentiviral, alpharetroviral, betaretroviral, gammaretroviral, deltaretroviral, and epsilonretroviral vector particles that may comprise retroviral Gag, Pol, and/or one or more accessory protein(s) and a Cocal vesiculovirus envelope protein. Within certain aspects of these embodiments, the Gag, Pol, and accessory proteins are lentiviral and/or gammaretroviral.

In some embodiments, a host cell is transiently or non-transiently transfected with one or more vectors described herein. In some embodiments, a cell is transfected as it naturally occurs in a subject optionally to be reintroduced therein. In some embodiments, a cell that is transfected is taken from a subject. In some embodiments, the cell is derived from cells taken from a subject, such as a cell line. A wide variety of cell lines for tissue culture are known in the art. Examples of cell lines include, but are not limited to, C8161, CCRF-CEM, MOLT, mIMCD-3, NHDF, HeLa-S3, Huh1, Huh4, Huh7, HUVEC, HASMC, HEKn, HEKa, MiaPaCell, Panc1, PC-3, TF1, CTLL-2, C1R, Rat6, CV1, RPTE, A10, T24, J82, A375, ARH-77, Calu1, SW480, SW620, SKOV3, SK-UT, CaCo2, P388D1, SEM-K2, WEHI-231, HB56, TIB55, Jurkat, J45.01, LRMB, Bcl-1, BC-3, IC21, DLD2, Raw264.7, NRK, NRK-52E, MRC5, MEF, Hep G2, HeLa B, HeLa T4, COS, COS-1, COS-6, COS-M6A, BS-C-1 monkey kidney epithelial, BALB/3T3 mouse embryo fibroblast, 3T3 Swiss, 3T3-L1, 132-d5 human fetal fibroblasts; 10.1 mouse fibroblasts, 293-T, 3T3, 721, 9L, A2780, A2780ADR, A2780cis, A172, A20, A253, A431, A-549, ALC, B16, B35, BCP-1 cells, BEAS-2B, bEnd.3, BHK-21, BR 293, BxPC3, C3H-10T1/2, C6/36, Cal-27, CHO, CHO-7, CHO-IR, CHO-K1, CHO-K2, CHO-T, CHO Dhfr −/−, COR-L23, COR-L23/CPR, COR-L23/5010, COR-L23/R23, COS-7, COV-434, CML T1, CMT, CT26, D17, DH82, DU145, DuCaP, EL4, EM2, EM3, EMT6/AR1, EMT6/AR10.0, FM3, H1299, H69, HB54, HB55, HCA2, HEK-293, HeLa, Hepa1c1c7, HL-60, HMEC, HT-29, Jurkat, JY cells, K562 cells, Ku812, KCL22, KG1, KYO1, LNCap, Ma-Mel 1-48, MC-38, MCF-7, MCF-10A, MDA-MB-231, MDA-MB-468, MDA-MB-435, MDCK II, MDCK II, MOR/0.2R, MONO-MAC 6, MTD-1A, MyEnd, NCI-H69/CPR, NCI-H69/LX10, NCI-H69/LX20, NCI-H69/LX4, NIH-3T3, NALM-1, NW-145, OPCN/OPCT cell lines, Peer, PNT-1A/PNT 2, RenCa, RIN- 5F, RMA/RMAS, Saos-2 cells, Sf-9, SkBr3, T2, T-47D, T84, THP1 cell line, U373, U87, U937, VCaP, Vero cells, WM39, WT-49, X63, YAC-1, YAR, and transgenic varieties thereof. Cell lines are available from a variety of sources known to those with skill in the art (see, e.g., the American Type Culture Collection (ATCC) (Manassas, Va.)).

In particular embodiments, transient expression and/or presence of one or more of the components of the AD-functionalized CRISPR system can be of interest, such as to reduce off-target effects. In some embodiments, a cell transfected with one or more vectors described herein is used to establish a new cell line comprising one or more vector-derived sequences. In some embodiments, a cell transiently transfected with the components of a AD-functionalized CRISPR system as described herein (such as by transient transfection of one or more vectors, or transfection with RNA), and modified through the activity of a CRISPR complex, is used to establish a new cell line comprising cells containing the modification but lacking any other exogenous sequence. In some embodiments, cells transiently or non-transiently transfected with one or more vectors described herein, or cell lines derived from such cells are used in assessing one or more test compounds.

In some embodiments it is envisaged to introduce the RNA and/or protein directly to the host cell. For instance, the CRISPR-Cas protein can be delivered as encoding mRNA together with an in vitro transcribed guide RNA. Such methods can reduce the time to ensure effect of the CRISPR-Cas protein and further prevents long-term expression of the CRISPR system components.

In some embodiments the RNA molecules of the invention are delivered in liposome or lipofectin formulations and the like and can be prepared by methods well known to those skilled in the art. Such methods are described, for example, in U.S. Pat. Nos. 5,593,972, 5,589,466, and 5,580,859, which are herein incorporated by reference. Delivery systems aimed specifically at the enhanced and improved delivery of siRNA into mammalian cells have been developed, (see, for example, Shen et al FEBS Let. 2003, 539: 111-114; Xia et al., Nat. Biotech. 2002, 20:1006-1010; Reich et al., Mol. Vision. 2003, 9: 210-216; Sorensen et al., J. Mol. Biol. 2003, 327: 761-766; Lewis et al., Nat. Gen. 2002, 32: 107-108 and Simeoni et al., NAR 2003, 31, 11: 2717-2724) and may be applied to the present invention. siRNA has recently been successfully used for inhibition of gene expression in primates (see for example. Tolentino et al., Retina 24(4):660 which may also be applied to the present invention.

Indeed, RNA delivery is a useful method of in vivo delivery. It is possible to deliver Cas13, adenosine deaminase, and guide RNA into cells using liposomes or nanoparticles. Thus delivery of the CRISPR-Cas protein, such as a Cas13, the delivery of the adenosine deaminase (which may be fused to the CRISPR-Cas protein or an adaptor protein), and/or delivery of the RNAs of the invention may be in RNA form and via microvesicles, liposomes or particle or particles. For example, Cas13 mRNA, adenosine deaminase mRNA, and guide RNA can be packaged into liposomal particles for delivery in vivo. Liposomal transfection reagents such as lipofectamine from Life Technologies and other reagents on the market can effectively deliver RNA molecules into the liver.

Means of delivery of RNA also preferred include delivery of RNA via particles (Cho, S., Goldberg, M., Son, S., Xu, Q., Yang, F., Mei, Y., Bogatyrev, S., Langer, R. and Anderson, D., Lipid-like nanoparticles for small interfering RNA delivery to endothelial cells, Advanced Functional Materials, 19: 3112-3118, 2010) or exosomes (Schroeder, A., Levins, C., Cortez, C., Langer, R., and Anderson, D., Lipid-based nanotherapeutics for siRNA delivery, Journal of Internal Medicine, 267: 9-21, 2010, PMID: 20059641). Indeed, exosomes have been shown to be particularly useful in delivery siRNA, a system with some parallels to the CRISPR system. For instance, El-Andaloussi S, et al. ("Exosome-mediated delivery of siRNA in vitro and in vivo." Nat Protoc. 2012 December; 7(12):2112-26. doi: 10.1038/nprot.2012.131. Epub 2012 Nov. 15.) describe how exosomes are promising tools for drug delivery across different biological barriers and can be harnessed for delivery of siRNA in vitro and in vivo. Their approach is to generate targeted exosomes through transfection of an expression vector, comprising an exosomal protein fused with a peptide ligand. The exosomes are then purify and characterized from transfected cell supernatant, then RNA is loaded into the exosomes. Delivery or administration according to the invention can be performed with exosomes, in particular but not limited to the brain. Vitamin E ($\alpha$-tocopherol) may be conjugated with CRISPR Cas and delivered to the brain along with high density lipoprotein (HDL), for example in a similar manner as was done by Uno et al. (HUMAN GENE THERAPY 22:711-719 (June 2011)) for delivering short-interfering RNA (siRNA) to the brain. Mice were infused via Osmotic minipumps (model 1007D; Alzet, Cupertino, CA) filled with phosphate-buffered saline (PBS) or free Tocsi-BACE or Toc-siBACE/HDL and connected with Brain Infusion Kit 3 (Alzet). A brain-infusion cannula was placed about 0.5 mm posterior to the bregma at midline for infusion into the dorsal third ventricle. Uno et al. found that as little as 3 nmol of Toc-siRNA with HDL could induce a target reduction in comparable degree by the same ICV infusion method. A similar dosage of CRISPR Cas conjugated to $\alpha$-tocopherol and co-administered with HDL targeted to the brain may be contemplated for humans in the present invention, for example, about 3 nmol to about 3 µmol of CRISPR Cas targeted to the brain may be contemplated. Zou et al. ((HUMAN GENE THERAPY 22:465-475 (April 2011)) describes a method of lentiviral-mediated delivery of short-hairpin RNAs targeting PKCγ for in vivo gene silencing in the spinal cord of rats. Zou et al. administered about 10 µl of a recombinant lentivirus having a titer of 1×109 transducing units (TU)/ml by an intrathecal catheter. A similar dosage of CRISPR Cas expressed in a lentiviral vector targeted to the brain may be contemplated for humans in the present invention, for example, about 10-50 ml of CRISPR Cas targeted to the brain in a lentivirus having a titer of $1\times10^9$ transducing units (TU)/ml may be contemplated.

Dosage of Vectors

In some embodiments, the vector, e.g., plasmid or viral vector is delivered to the tissue of interest by, for example, an intramuscular injection, while other times the delivery is via intravenous, transdermal, intranasal, oral, mucosal, or other delivery methods. Such delivery may be either via a single dose, or multiple doses. One skilled in the art understands that the actual dosage to be delivered herein may vary greatly depending upon a variety of factors, such as the vector choice, the target cell, organism, or tissue, the general condition of the subject to be treated, the degree of transformation/modification sought, the administration route, the administration mode, the type of transformation/modification sought, etc.

Such a dosage may further contain, for example, a carrier (water, saline, ethanol, glycerol, lactose, sucrose, calcium phosphate, gelatin, dextran, agar, pectin, peanut oil, sesame oil, etc.), a diluent, a pharmaceutically-acceptable carrier (e.g., phosphate-buffered saline), a pharmaceutically-acceptable excipient, and/or other compounds known in the art. The dosage may further contain one or more pharmaceutically acceptable salts such as, for example, a mineral acid salt such as a hydrochloride, a hydrobromide, a phosphate, a sulfate, etc.; and the salts of organic acids such as acetates, propionates, malonates, benzoates, etc. Additionally, auxiliary substances, such as wetting or emulsifying agents, pH buffering substances, gels or gelling materials, flavorings, colorants, microspheres, polymers, suspension agents, etc. may also be present herein. In addition, one or more other conventional pharmaceutical ingredients, such as preservatives, humectants, suspending agents, surfactants, antioxidants, anticaking agents, fillers, chelating agents, coating agents, chemical stabilizers, etc. may also be present, especially if the dosage form is a reconstitutable form. Suitable exemplary ingredients include microcrystalline cellulose, carboxymethylcellulose sodium, polysorbate 80, phenylethyl alcohol, chlorobutanol, potassium sorbate, sorbic acid, sulfur dioxide, propyl gallate, the parabens, ethyl vanillin, glycerin, phenol, parachlorophenol, gelatin, albumin and a combination thereof. A thorough discussion of pharmaceutically acceptable excipients is available in REMINGTON'S PHARMACEUTICAL SCIENCES (Mack Pub. Co., N.J. 1991) which is incorporated by reference herein.

In an embodiment herein the delivery is via an adenovirus, which may be at a single booster dose containing at least $1\times10^5$ particles (also referred to as particle units, pu) of adenoviral vector. In an embodiment herein, the dose preferably is at least about $1\times10^6$ particles (for example, about $1\times10^6$-$1\times10^{12}$ particles), more preferably at least about $1\times10^7$ particles, more preferably at least about $1\times10^8$ particles (e.g., about $1\times10^8$-$1\times10^{11}$ particles or about $1\times10^8$-$1\times10^{12}$ particles), and most preferably at least about $1\times10^{00}$ particles (e.g., about $1\times10^9$-$1\times10^{10}$ particles or about $1\times10^9$-$1\times10^{12}$ particles), or even at least about $1\times10^{10}$ particles (e.g., about $1\times10^{10}$-$1\times10^{12}$ particles) of the adenoviral vector. Alternatively, the dose comprises no more than about $1\times10^{14}$ particles, preferably no more than about $1\times10^{13}$ particles, even more preferably no more than about $1\times10^{12}$ particles, even more preferably no more than about $1\times10^{11}$ particles, and most preferably no more than about $1\times10^{10}$ particles (e.g., no more than about $1\times10^9$ articles). Thus, the dose may contain a single dose of adenoviral vector with, for example, about $1\times10^6$ particle units (pu), about $2\times10^6$ pu, about $4\times10^6$ pu, about $1\times10^7$ pu, about $2\times10^7$ pu, about $4\times10^7$ pu, about $1\times10^8$ pu, about $2\times10^8$ pu, about $4\times10^8$ pu, about $1\times10^9$ pu, about $2\times10^9$ pu, about $4\times10^9$ pu, about $1\times10^{10}$ pu, about $2\times10^{10}$ pu, about $4\times10^{10}$ pu, about $1\times10^{11}$ pu, about $2\times10^{11}$ pu, about $4\times10^{11}$ pu, about $1\times10^{12}$ pu, about $2\times10^{12}$ pu, or about $4\times10^{12}$ pu of adenoviral vector. See, for example, the adenoviral vectors in U.S. Pat. No. 8,454,972 B2 to Nabel, et. al., granted on Jun. 4, 2013; incorporated by reference herein, and the dosages at col 29, lines 36-58 thereof. In an embodiment herein, the adenovirus is delivered via multiple doses.

In an embodiment herein, the delivery is via an AAV. A therapeutically effective dosage for in vivo delivery of the AAV to a human is believed to be in the range of from about 20 to about 50 ml of saline solution containing from about $1\times10^{10}$ to about $1\times10^{10}$ functional AAV/ml solution. The dosage may be adjusted to balance the therapeutic benefit against any side effects. In an embodiment herein, the AAV dose is generally in the range of concentrations of from about $1\times10^5$ to $1\times10^{50}$ genomes AAV, from about $1\times10^8$ to $1\times10^{20}$ genomes AAV, from about $1\times10^{10}$ to about $1\times10^{16}$ genomes, or about $1\times10^{11}$ to about $1\times10^{16}$ genomes AAV. A human dosage may be about $1\times10^{13}$ genomes AAV. Such concentrations may be delivered in from about 0.001 ml to about 100 ml, about 0.05 to about 50 ml, or about 10 to about 25 ml of a carrier solution. Other effective dosages can be readily established by one of ordinary skill in the art through routine trials establishing dose response curves. See, for example, U.S. Pat. No. 8,404,658 B2 to Hajjar, et al., granted on Mar. 26, 2013, at col. 27, lines 45-60.

In an embodiment herein the delivery is via a plasmid. In such plasmid compositions, the dosage should be a sufficient amount of plasmid to elicit a response. For instance, suitable quantities of plasmid DNA in plasmid compositions can be from about 0.1 to about 2 mg, or from about 1 µg to about 10 µg per 70 kg individual. Plasmids of the invention will generally comprise (i) a promoter; (ii) a sequence encoding a CRISPR-Cas protein, operably linked to said promoter; (iii) a selectable marker; (iv) an origin of replication; and (v) a transcription terminator downstream of and operably linked to (ii). The plasmid can also encode the RNA components of a CRISPR complex, but one or more of these may instead be encoded on a different vector.

The doses herein are based on an average 70 kg individual. The frequency of administration is within the ambit of the medical or veterinary practitioner (e.g., physician, veterinarian), or scientist skilled in the art. It is also noted that mice used in experiments are typically about 20 g and from mice experiments one can scale up to a 70 kg individual.

The dosage used for the compositions provided herein include dosages for repeated administration or repeat dosing. In particular embodiments, the administration is repeated within a period of several weeks, months, or years. Suitable assays can be performed to obtain an optimal dosage regime. Repeated administration can allow the use of lower dosage, which can positively affect off-target modifications.

RNA Delivery

In particular embodiments, RNA based delivery is used. In these embodiments, mRNA of the CRISPR-Cas protein, mRNA of the adenosine deaminase (which may be fused to a CRISPR-Cas protein or an adaptor), are delivered together with in vitro transcribed guide RNA. Liang et al. describes efficient genome editing using RNA based delivery (Protein Cell. 2015 May; 6(5): 363-372). In some embodiments, the mRNA(s) encoding Cas13 and/or adenosine deaminase can be chemically modified, which may lead to improved activity compared to plasmid-encoded Cas13 and/or adenosine deaminase. For example, uridines in the mRNA(s) can be partially or fully substituted with pseudouridine (Ψ), N1-methylpseudouridine (me1Ψ), 5-methoxyuridine (5moU). See Li et al., Nature Biomedical Engineering 1, 0066 DOI:10.1038/s41551-017-0066 (2017), which is incorporated herein by reference in its entirety.

RNP Delivery

In particular embodiments, pre-complexed guide RNA, CRISPR-Cas protein, and adenosine deaminase (which may be fused to a CRISPR-Cas protein or an adaptor) are delivered as a ribonucleoprotein (RNP). RNPs have the advantage that they lead to rapid editing effects even more so than the RNA method because this process avoids the need for transcription. An important advantage is that both RNP delivery is transient, reducing off-target effects and toxicity issues. Efficient genome editing in different cell types has been observed by Kim et al. (2014, Genome Res. 24(6):1012-9), Paix et al. (2015, Genetics 204(1):47-54), Chu et al. (2016, BMC Biotechnol. 16:4), and Wang et al. (2013, Cell. 9; 153(4):910-8).

In particular embodiments, the ribonucleoprotein is delivered by way of a polypeptide-based shuttle agent as described in WO2016161516. WO2016161516 describes efficient transduction of polypeptide cargos using synthetic peptides comprising an endosome leakage domain (ELD) operably linked to a cell penetrating domain (CPD), to a histidine-rich domain and a CPD. Similarly these polypeptides can be used for the delivery of CRISPR-effector based RNPs in eukaryotic cells.

Particles

In some aspects or embodiments, a composition comprising a delivery particle formulation may be used. In some aspects or embodiments, the formulation comprises a CRISPR complex, the complex comprising a CRISPR protein and a guide which directs sequence-specific binding of the CRISPR complex to a target sequence. In some embodiments, the delivery particle comprises a lipid-based particle, optionally a lipid nanoparticle, or cationic lipid and optionally biodegradable polymer. In some embodiments, the cationic lipid comprises 1,2-dioleoyl-3-trimethylammonium-propane (DOTAP). In some embodiments, the hydrophilic polymer comprises ethylene glycol or polyethylene glycol. In some embodiments, the delivery particle further comprises a lipoprotein, preferably cholesterol. In some embodiments, the delivery particles are less than 500 nm in diameter, optionally less than 250 nm in diameter, optionally less than 100 nm in diameter, optionally about 35 nm to about 60 nm in diameter.

Example particle delivery complexes are further disclosed in U.S. Provisional Application entitled "Novel Delivery of Large Payloads" filed 62/485,625 filed Apr. 14, 2017.

Several types of particle delivery systems and/or formulations are known to be useful in a diverse spectrum of biomedical applications. In general, a particle is defined as a small object that behaves as a whole unit with respect to its transport and properties. Particles are further classified according to diameter. Coarse particles cover a range between 2,500 and 10,000 nanometers. Fine particles are sized between 100 and 2,500 nanometers. Ultrafine particles, or nanoparticles, are generally between 1 and 100 nanometers in size. The basis of the 100-nm limit is the fact that novel properties that differentiate particles from the bulk material typically develop at a critical length scale of under 100 nm.

As used herein, a particle delivery system/formulation is defined as any biological delivery system/formulation which includes a particle in accordance with the present invention. A particle in accordance with the present invention is any entity having a greatest dimension (e.g. diameter) of less than 100 microns (μm). In some embodiments, inventive particles have a greatest dimension of less than 10 μm. In some embodiments, inventive particles have a greatest dimension of less than 2000 nanometers (nm). In some embodiments, inventive particles have a greatest dimension of less than 1000 nanometers (nm). In some embodiments, inventive particles have a greatest dimension of less than 900 nm, 800 nm, 700 nm, 600 nm, 500 nm, 400 nm, 300 nm, 200 nm, or 100 nm. Typically, inventive particles have a greatest dimension (e.g., diameter) of 500 nm or less. In some embodiments, inventive particles have a greatest dimension (e.g., diameter) of 250 nm or less. In some embodiments, inventive particles have a greatest dimension (e.g., diameter) of 200 nm or less. In some embodiments, inventive particles have a greatest dimension (e.g., diameter) of 150 nm or less. In some embodiments, inventive particles have a greatest dimension (e.g., diameter) of 100 nm or less. Smaller particles, e.g., having a greatest dimension of 50 nm or less are used in some embodiments of the invention. In some embodiments, inventive particles have a greatest dimension ranging between 25 nm and 200 nm.

In terms of this invention, it is preferred to have one or more components of CRISPR complex, e.g., CRISPR-Cas protein or mRNA, or adenosine deaminase (which may be fused to a CRISPR-Cas protein or an adaptor) or mRNA, or guide RNA delivered using nanoparticles or lipid envelopes. Other delivery systems or vectors are may be used in conjunction with the nanoparticle aspects of the invention.

In general, a "nanoparticle" refers to any particle having a diameter of less than 1000 nm. In certain preferred embodiments, nanoparticles of the invention have a greatest dimension (e.g., diameter) of 500 nm or less. In other preferred embodiments, nanoparticles of the invention have a greatest dimension ranging between 25 nm and 200 nm. In other preferred embodiments, nanoparticles of the invention have a greatest dimension of 100 nm or less. In other preferred embodiments, nanoparticles of the invention have a greatest dimension ranging between 35 nm and 60 nm. It will be appreciated that reference made herein to particles or nanoparticles can be interchangeable, where appropriate.

It will be understood that the size of the particle will differ depending as to whether it is measured before or after loading. Accordingly, in particular embodiments, the term "nanoparticles" may apply only to the particles pre loading.

Nanoparticles encompassed in the present invention may be provided in different forms, e.g., as solid nanoparticles (e.g., metal such as silver, gold, iron, titanium), non-metal, lipid-based solids, polymers), suspensions of nanoparticles, or combinations thereof. Metal, dielectric, and semiconductor nanoparticles may be prepared, as well as hybrid structures (e.g., core-shell nanoparticles). Nanoparticles made of semiconducting material may also be labeled quantum dots if they are small enough (typically sub 10 nm) that quantization of electronic energy levels occurs. Such nanoscale particles are used in biomedical applications as drug carriers or imaging agents and may be adapted for similar purposes in the present invention.

Semi-solid and soft nanoparticles have been manufactured, and are within the scope of the present invention. A prototype nanoparticle of semi-solid nature is the liposome. Various types of liposome nanoparticles are currently used clinically as delivery systems for anticancer drugs and vaccines. Nanoparticles with one half hydrophilic and the other half hydrophobic are termed Janus particles and are particularly effective for stabilizing emulsions. They can self-assemble at water/oil interfaces and act as solid surfactants.

Particle characterization (including e.g., characterizing morphology, dimension, etc.) is done using a variety of different techniques. Common techniques are electron microscopy (TEM, SEM), atomic force microscopy (AFM), dynamic light scattering (DLS), X-ray photoelectron spectroscopy (XPS), powder X-ray diffraction (XRD), Fourier transform infrared spectroscopy (FTIR), matrix-assisted laser desorption/ionization time-of-flight mass spectrometry (MALDI-TOF), ultraviolet-visible spectroscopy, dual polarization interferometry and nuclear magnetic resonance (NMR). Characterization (dimension measurements) may be made as to native particles (i.e., preloading) or after loading of the cargo (herein cargo refers to e.g., one or more components of CRISPR-Cas system e.g., CRISPR-Cas protein or mRNA, adenosine deaminase (which may be fused to a CRISPR-Cas protein or an adaptor) or mRNA, or guide RNA, or any combination thereof, and may include additional carriers and/or excipients) to provide particles of an optimal size for delivery for any in vitro, ex vivo and/or in vivo application of the present invention. In certain preferred embodiments, particle dimension (e.g., diameter) characterization is based on measurements using dynamic laser scattering (DLS). Mention is made of U.S. Pat. Nos. 8,709,843; 6,007,845; 5,855,913; 5,985,309; 5,543,158; and the publication by James E. Dahlman and Carmen Barnes et al. Nature Nanotechnology (2014) published online 11 May 2014, doi:10.1038/nnano.2014.84, concerning particles, methods of making and using them and measurements thereof.

Particles delivery systems within the scope of the present invention may be provided in any form, including but not limited to solid, semi-solid, emulsion, or colloidal particles. As such any of the delivery systems described herein, including but not limited to, e.g., lipid-based systems, liposomes, micelles, microvesicles, exosomes, or gene gun may be provided as particle delivery systems within the scope of the present invention.

CRISPR-Cas protein mRNA, adenosine deaminase (which may be fused to a CRISPR-Cas protein or an adaptor) or mRNA, and guide RNA may be delivered simultaneously using particles or lipid envelopes; for instance, CRISPR-Cas protein and RNA of the invention, e.g., as a complex, can be delivered via a particle as in Dahlman et al., WO2015089419 A2 and documents cited therein, such as 7C1 (see, e.g., James E. Dahlman and Carmen Barnes et al. Nature Nanotechnology (2014) published online 11 May 2014, doi:10.1038/nnano.2014.84), e.g., delivery particle comprising lipid or lipidoid and hydrophilic polymer, e.g., cationic lipid and hydrophilic polymer, for instance wherein the cationic lipid comprises 1,2-dioleoyl-3-trimethylammonium-propane (DOTAP) or 1,2-ditetradecanoyl-sn-glycero-3-phosphocholine (DMPC) and/or wherein the hydrophilic polymer comprises ethylene glycol or polyethylene glycol (PEG); and/or wherein the particle further comprises cholesterol (e.g., particle from formulation 1=DOTAP 100, DMPC 0, PEG 0, Cholesterol 0; formulation number 2=DOTAP 90, DMPC 0, PEG 10, Cholesterol 0; formulation number 3=DOTAP 90, DMPC 0, PEG 5, Cholesterol 5), wherein particles are formed using an efficient, multistep process wherein first, effector protein and RNA are mixed together, e.g., at a 1:1 molar ratio, e.g., at room temperature, e.g., for 30 minutes, e.g., in sterile, nuclease free 1×PBS; and separately, DOTAP, DMPC, PEG, and cholesterol as applicable for the formulation are dissolved in alcohol, e.g., 100% ethanol; and, the two solutions are mixed together to form particles containing the complexes).

Nucleic acid-targeting effector proteins (e.g., a Type V protein such as Cas13) mRNA and guide RNA may be delivered simultaneously using particles or lipid envelopes. Examples of suitable particles include but are not limited to those described in U.S. Pat. No. 9,301,923.

For example, Su X, Fricke J, Kavanagh D G, Irvine D J ("In vitro and in vivo mRNA delivery using lipid-enveloped pH-responsive polymer nanoparticles" Mol Pharm. 2011 Jun. 6; 8(3):774-87. doi: 10.1021/mp100390w. Epub 2011 Apr. 1) describes biodegradable core-shell structured nanoparticles with a poly(O-amino ester) (PBAE) core enveloped by a phospholipid bilayer shell. These were developed for in vivo mRNA delivery. The pH-responsive PBAE component was chosen to promote endosome disruption, while the lipid surface layer was selected to minimize toxicity of the polycation core. Such are, therefore, preferred for delivering RNA of the present invention.

In one embodiment, particles/nanoparticles based on self assembling bioadhesive polymers are contemplated, which may be applied to oral delivery of peptides, intravenous delivery of peptides and nasal delivery of peptides, all to the brain. Other embodiments, such as oral absorption and ocular delivery of hydrophobic drugs are also contemplated. The molecular envelope technology involves an engineered polymer envelope which is protected and delivered to the site of the disease (see, e.g., Mazza, M. et al. ACSNano, 2013. 7(2): 1016-1026; Siew, A., et al. Mol Pharm, 2012. 9(1):14-28; Lalatsa, A., et al. J Contr Rel, 2012. 161(2):523-36; Lalatsa, A., et al., Mol Pharm, 2012. 9(6):1665-80; Lalatsa, A., et al. Mol Pharm, 2012. 9(6):1764-74; Garrett, N. L., et al. J Biophotonics, 2012. 5(5-6):458-68; Garrett, N. L., et al. J Raman Spect, 2012. 43(5):681-688; Ahmad, S., et al. J Royal Soc Interface 2010. 7:S423-33; Uchegbu, I. F. Expert Opin Drug Deliv, 2006. 3(5):629-40; Qu, X., et al. Biomacromolecules, 2006. 7(12):3452-9 and Uchegbu, I. F., et al. Int J Pharm, 2001. 224:185-199). Doses of about 5 mg/kg are contemplated, with single or multiple doses, depending on the target tissue.

In one embodiment, particles/nanoparticles that can deliver RNA to a cancer cell to stop tumor growth developed by Dan Anderson's lab at MIT may be used/and or adapted to the AD-functionalized CRISPR-Cas system of the present invention. In particular, the Anderson lab developed fully automated, combinatorial systems for the synthesis, purification, characterization, and formulation of new biomaterials and nanoformulations. See, e.g., Alabi et al., Proc Natl Acad Sci USA. 2013 Aug. 6; 110(32):12881-6; Zhang et al., Adv Mater. 2013 Sep. 6; 25(33):4641-5; Jiang et al., Nano Lett. 2013 Mar. 13; 13(3):1059-64; Karagiannis et al., ACS Nano. 2012 Oct. 23; 6(10):8484-7; Whitehead et al., ACS Nano. 2012 Aug. 28; 6(8):6922-9 and Lee et al., Nat Nanotechnol. 2012 Jun. 3; 7(6):389-93.

US patent application 20110293703 relates to lipidoid compounds are also particularly useful in the administration of polynucleotides, which may be applied to deliver the AD-functionalized CRISPR-Cas system of the present invention. In one aspect, the aminoalcohol lipidoid compounds are combined with an agent to be delivered to a cell or a subject to form microparticles, nanoparticles, liposomes, or micelles. The agent to be delivered by the particles, liposomes, or micelles may be in the form of a gas, liquid, or solid, and the agent may be a polynucleotide, protein, peptide, or small molecule. The aminoalcohol lipidoid compounds may be combined with other aminoalcohol lipidoid compounds, polymers (synthetic or natural), surfactants, cholesterol, carbohydrates, proteins, lipids, etc. to form the particles. These particles may then optionally be combined with a pharmaceutical excipient to form a pharmaceutical composition.

US Patent Publication No. 20110293703 also provides methods of preparing the aminoalcohol lipidoid compounds. One or more equivalents of an amine are allowed to react with one or more equivalents of an epoxide-terminated compound under suitable conditions to form an aminoalcohol lipidoid compound of the present invention. In certain embodiments, all the amino groups of the amine are fully reacted with the epoxide-terminated compound to form tertiary amines. In other embodiments, all the amino groups of the amine are not fully reacted with the epoxide-terminated compound to form tertiary amines thereby resulting in primary or secondary amines in the aminoalcohol lipidoid compound. These primary or secondary amines are left as is or may be reacted with another electrophile such as a different epoxide-terminated compound. As will be appreciated by one skilled in the art, reacting an amine with less than excess of epoxide-terminated compound will result in a plurality of different aminoalcohol lipidoid compounds with various numbers of tails. Certain amines may be fully functionalized with two epoxide-derived compound tails while other molecules will not be completely functionalized with epoxide-derived compound tails. For example, a diamine or polyamine may include one, two, three, or four epoxide-derived compound tails off the various amino moieties of the molecule resulting in primary, secondary, and tertiary amines. In certain embodiments, all the amino groups are not fully functionalized. In certain embodiments, two of the same types of epoxide-terminated compounds are used. In other embodiments, two or more different epoxide-terminated compounds are used. The synthesis of the aminoalcohol lipidoid compounds is performed with or without solvent, and the synthesis may be performed at higher temperatures ranging from 30-100° C., preferably at approximately 50-90° C. The prepared aminoalcohol lipidoid compounds may be optionally purified. For example, the mixture of aminoalcohol lipidoid compounds may be purified to yield an aminoalcohol lipidoid compound with a particular number of epoxide-derived compound tails. Or the mixture may be purified to yield a particular stereo- or regioisomer. The aminoalcohol lipidoid compounds may also be alkylated using an alkyl halide (e.g., methyl iodide) or other alkylating agent, and/or they may be acylated.

US Patent Publication No. 20110293703 also provides libraries of aminoalcohol lipidoid compounds prepared by the inventive methods. These aminoalcohol lipidoid compounds may be prepared and/or screened using high-throughput techniques involving liquid handlers, robots, microtiter plates, computers, etc. In certain embodiments, the aminoalcohol lipidoid compounds are screened for their ability to transfect polynucleotides or other agents (e.g., proteins, peptides, small molecules) into the cell.

US Patent Publication No. 20130302401 relates to a class of poly(beta-amino alcohols) (PBAAs) has been prepared using combinatorial polymerization. The inventive PBAAs may be used in biotechnology and biomedical applications as coatings (such as coatings of films or multilayer films for medical devices or implants), additives, materials, excipients, non-biofouling agents, micropatterning agents, and cellular encapsulation agents. When used as surface coatings, these PBAAs elicited different levels of inflammation, both in vitro and in vivo, depending on their chemical structures. The large chemical diversity of this class of materials allowed us to identify polymer coatings that inhibit macrophage activation in vitro. Furthermore, these coatings reduce the recruitment of inflammatory cells, and reduce fibrosis, following the subcutaneous implantation of carboxylated polystyrene microparticles. These polymers may be used to form polyelectrolyte complex capsules for cell encapsulation. The invention may also have many other biological applications such as antimicrobial coatings, DNA or siRNA delivery, and stem cell tissue engineering. The teachings of US Patent Publication No. 20130302401 may be applied to the AD-functionalized CRISPR-Cas system of the present invention.

Preassembled recombinant CRISPR-Cas complexes comprising Cas13, adenosine deaminase (which may be fused to Cas13 or an adaptor protein), and guide RNA may be transfected, for example by electroporation, resulting in high mutation rates and absence of detectable off-target mutations. Hur, J. K. et al, Targeted mutagenesis in mice by electroporation of Cas13 ribonucleoproteins, Nat Biotechnol. 2016 Jun. 6. doi: 10.1038/nbt.3596.

In terms of local delivery to the brain, this can be achieved in various ways. For instance, material can be delivered intrastriatally e.g. by injection. Injection can be performed stereotactically via a craniotomy.

In some embodiments, sugar-based particles may be used, for example GalNAc, as described herein and with reference to WO2014118272 (incorporated herein by reference) and Nair, J K et al., 2014, Journal of the American Chemical Society 136 (49), 16958-16961) and the teaching herein, especially in respect of delivery applies to all particles unless otherwise apparent. This may be considered to be a sugar-based particle and further details on other particle delivery systems and/or formulations are provided herein. GalNAc can therefore be considered to be a particle in the sense of the other particles described herein, such that general uses and other considerations, for instance delivery of said particles, apply to GalNAc particles as well. A solution-phase conjugation strategy may for example be used to attach triantennary GalNAc clusters (mol. wt. ~2000) activated as PFP (pentafluorophenyl) esters onto 5'-hexylamino modified oligonucleotides (5'-HA ASOs, mol. wt. ~8000 Da; Østergaard et al., Bioconjugate Chem., 2015, 26 (8), pp 1451-1455). Similarly, poly(acrylate) polymers have been described for in vivo nucleic acid delivery (see WO2013158141 incorporated herein by reference). In further alternative embodiments, pre-mixing CRISPR nanoparticles (or protein complexes) with naturally occurring serum proteins may be used in order to improve delivery (Akinc A et al, 2010, Molecular Therapy vol. 18 no. 7, 1357-1364).

Nanoclews

Further, the AD-functionalized CRISPR system may be delivered using nanoclews, for example as described in Sun W et al, *Cocoon-like self-degradable DNA nanoclew for anticancer drug delivery.*, J Am Chem Soc. 2014 Oct. 22; 136(42):14722-5. doi: 10.1021/ja5088024. Epub 2014 Oct. 13.; or in Sun W et al, *Self-Assembled DNA Nanoclews for the Efficient Delivery of CRISPR-Cas9 for Genome Editing.*, Angew Chem Int Ed Engl. 2015 Oct. 5; 54(41):12029-33. doi: 10.1002/anie.201506030. Epub 2015 Aug. 27.

LNP

In some embodiments, delivery is by encapsulation of the Cas13 protein or mRNA form in a lipid particle such as an LNP. In some embodiments, therefore, lipid nanoparticles (LNPs) are contemplated. An anti-transthyretin small interfering RNA has been encapsulated in lipid nanoparticles and delivered to humans (see, e.g., Coelho et al., N Engl J Med 2013; 369:819-29), and such a system may be adapted and applied to the CRISPR Cas system of the present invention. Doses of about 0.01 to about 1 mg per kg of body weight administered intravenously are contemplated. Medications to reduce the risk of infusion-related reactions are contemplated, such as dexamethasone, acetampinophen, diphenhydramine or cetirizine, and ranitidine are contemplated. Multiple doses of about 0.3 mg per kilogram every 4 weeks for five doses are also contemplated.

LNPs have been shown to be highly effective in delivering siRNAs to the liver (see, e.g., Tabernero et al., Cancer Discovery, April 2013, Vol. 3, No. 4, pages 363-470) and are therefore contemplated for delivering RNA encoding CRISPR Cas to the liver. A dosage of about four doses of 6 mg/kg of the LNP every two weeks may be contemplated. Tabernero et al. demonstrated that tumor regression was observed after the first 2 cycles of LNPs dosed at 0.7 mg/kg, and by the end of 6 cycles the patient had achieved a partial response with complete regression of the lymph node metastasis and substantial shrinkage of the liver tumors. A complete response was obtained after 40 doses in this patient, who has remained in remission and completed treatment after receiving doses over 26 months. Two patients with RCC and extrahepatic sites of disease including kidney, lung, and lymph nodes that were progressing following prior therapy with VEGF pathway inhibitors had stable disease at all sites for approximately 8 to 12 months, and a patient with PNET and liver metastases continued on the extension study for 18 months (36 doses) with stable disease.

However, the charge of the LNP must be taken into consideration. As cationic lipids combined with negatively charged lipids to induce nonbilayer structures that facilitate intracellular delivery. Because charged LNPs are rapidly cleared from circulation following intravenous injection, ionizable cationic lipids with pKa values below 7 were developed (see, e.g., Rosin et al, Molecular Therapy, vol. 19, no. 12, pages 1286-2200, December 2011). Negatively charged polymers such as RNA may be loaded into LNPs at low pH values (e.g., pH 4) where the ionizable lipids display a positive charge. However, at physiological pH values, the LNPs exhibit a low surface charge compatible with longer circulation times. Four species of ionizable cationic lipids have been focused upon, namely 1,2-dilineoyl-3-dimethylammonium-propane (DLinDAP), 1,2-dilinoleyloxy-3-N,N-dimethylaminopropane (DLinDMA), 1,2-dilinoleyloxy-keto-N,N-dimethyl-3-aminopropane (DLinKDMA), and 1,2-dilinoleyl-4-(2-dimethylaminoethyl)-[1,3]-dioxolane (DLinKC2-DMA). It has been shown that LNP siRNA systems containing these lipids exhibit remarkably different gene silencing properties in hepatocytes in vivo, with potencies varying according to the series DLinKC2-DMA>DLinKDMA>DLinDMA>>DLinDAP employing a Factor VII gene silencing model (see, e.g., Rosin et al, Molecular Therapy, vol. 19, no. 12, pages 1286-2200, December 2011). A dosage of 1 μg/ml of LNP or CRISPR-Cas RNA in or associated with the LNP may be contemplated, especially for a formulation containing DLinKC2-DMA.

Preparation of LNPs and CRISPR Cas encapsulation may be used/and or adapted from Rosin et al, Molecular Therapy, vol. 19, no. 12, pages 1286-2200, December 2011). The cationic lipids 1,2-dilineoyl-3-dimethylammonium-propane (DLinDAP), 1,2-dilinoleyloxy-3-N,N-dimethylaminopropane (DLinDMA), 1,2-dilinoleyloxyketo-N,N-dimethyl-3-aminopropane (DLinK-DMA), 1,2-dilinoleyl-4-(2-dimethylaminoethyl)-[1,3]-dioxolane (DLinKC2-DMA), (3-o-[2"-(methoxypolyethyleneglycol 2000) succinoyl]-1,2-dimyristoyl-sn-glycol (PEG-S-DMG), and R-3-[(ω-methoxy-poly(ethylene glycol)2000) carbamoyl]-1,2-dimyristyloxypropyl-3-amine (PEG-C-DOMG) may be provided by Tekmira Pharmaceuticals (Vancouver, Canada) or synthesized. Cholesterol may be purchased from Sigma (St Louis, MO). The specific CRISPR Cas RNA may be encapsulated in LNPs containing DLinDAP, DLinDMA, DLinK-DMA, and DLinKC2-DMA (cationic lipid:DSPC:CHOL:PEGS-DMG or PEG-C-DOMG at 40:10:40:10 molar ratios). When required, 0.2% SP-DiOC18 (Invitrogen, Burlington, Canada) may be incorporated to assess cellular uptake, intracellular delivery, and biodistribution. Encapsulation may be performed by dissolving lipid mixtures comprised of cationic lipid:DSPC:cholesterol:PEG-c-DOMG (40:10:40:10 molar ratio) in ethanol to a final lipid concentration of 10 mmol/l. This ethanol solution of lipid may be added drop-wise to 50 mmol/l citrate, pH 4.0 to form multilamellar vesicles to produce a final concentration of 30% ethanol vol/vol. Large unilamellar vesicles may be formed following extrusion of multilamellar vesicles through two stacked 80 nm Nuclepore polycarbonate filters using the Extruder (Northern Lipids, Vancouver, Canada). Encapsulation may be achieved by adding RNA dissolved at 2 mg/ml in 50 mmol/l citrate, pH 4.0 containing 30% ethanol vol/vol drop-wise to extruded preformed large unilamellar vesicles and incubation at 31° C. for 30 minutes with constant mixing to a final RNA/lipid weight ratio of 0.06/1 wt/wt. Removal of ethanol and neutralization of formulation buffer were performed by dialysis against phosphate-buffered saline (PBS), pH 7.4 for 16 hours using Spectra/Por 2 regenerated cellulose dialysis membranes. Nanoparticle size distribution may be determined by dynamic light scattering using a NICOMP 370 particle sizer, the vesicle/intensity modes, and *Gaussian* fitting (Nicomp Particle Sizing, Santa Barbara, CA). The particle size for all three LNP systems may be ~70 nm in diameter. RNA encapsulation efficiency may be determined by removal of free RNA using VivaPureD MiniH columns (Sartorius Stedim Biotech) from samples collected before and after dialysis. The encapsulated RNA may be extracted from the eluted nanoparticles and quantified at 260 nm. RNA to lipid ratio was determined by measurement of cholesterol content in vesicles using the Cholesterol E enzymatic assay from Wako Chemicals USA (Richmond, VA). In conjunction with the herein discussion of LNPs and PEG lipids, PEGylated liposomes or LNPs are likewise suitable for delivery of a CRISPR-Cas system or components thereof.

A lipid premix solution (20.4 mg/ml total lipid concentration) may be prepared in ethanol containing DLinKC2-DMA, DSPC, and cholesterol at 50:10:38.5 molar ratios. Sodium acetate may be added to the lipid premix at a molar ratio of 0.75:1 (sodium acetate:DLinKC2-DMA). The lipids may be subsequently hydrated by combining the mixture with 1.85 volumes of citrate buffer (10 mmol/1, pH 3.0) with vigorous stirring, resulting in spontaneous liposome formation in aqueous buffer containing 35% ethanol. The liposome solution may be incubated at 37° C. to allow for time-dependent increase in particle size. Aliquots may be removed at various times during incubation to investigate changes in liposome size by dynamic light scattering (Zetasizer Nano Z S, Malvern Instruments, Worcestershire, UK). Once the desired particle size is achieved, an aqueous PEG lipid solution (stock=10 mg/ml PEG-DMG in 35% (vol/vol) ethanol) may be added to the liposome mixture to yield a final PEG molar concentration of 3.5% of total lipid. Upon addition of PEG-lipids, the liposomes should their size, effectively quenching further growth. RNA may then be added to the empty liposomes at an RNA to total lipid ratio of approximately 1:10 (wt:wt), followed by incubation for 30 minutes at 37° C. to form loaded LNPs. The mixture may be subsequently dialyzed overnight in PBS and filtered with a 0.45-μm syringe filter.

Spherical Nucleic Acid (SNA™) constructs and other nanoparticles (particularly gold nanoparticles) are also contemplated as a means to delivery CRISPR-Cas system to intended targets. Significant data show that AuraSense Therapeutics' Spherical Nucleic Acid (SNA™) constructs, based upon nucleic acid-functionalized gold nanoparticles, are useful.

Literature that may be employed in conjunction with herein teachings include: Cutler et al., J. Am. Chem. Soc. 2011 133:9254-9257, Hao et al., Small. 2011 7:3158-3162, Zhang et al., ACS Nano. 2011 5:6962-6970, Cutler et al., J. Am. Chem. Soc. 2012 134:1376-1391, Young et al., Nano Lett. 2012 12:3867-71, Zheng et al., Proc. Natl. Acad. Sci.

USA. 2012 109:11975-80, Mirkin, Nanomedicine 2012 7:635-638 Zhang et al., J. Am. Chem. Soc. 2012 134:16488-1691, Weintraub, Nature 2013 495:S14-S16, Choi et al., Proc. Natl. Acad. Sci. USA. 2013 110(19):7625-7630, Jensen et al., Sci. Transl. Med. 5, 209ra152 (2013) and Mirkin, et al., Small, 10:186-192.

Self-assembling nanoparticles with RNA may be constructed with polyethyleneimine (PEI) that is PEGylated with an Arg-Gly-Asp (RGD) peptide ligand attached at the distal end of the polyethylene glycol (PEG). This system has been used, for example, as a means to target tumor neovasculature expressing integrins and deliver siRNA inhibiting vascular endothelial growth factor receptor-2 (VEGF R2) expression and thereby achieve tumor angiogenesis (see, e.g., Schiffelers et al., Nucleic Acids Research, 2004, Vol. 32, No. 19). Nanoplexes may be prepared by mixing equal volumes of aqueous solutions of cationic polymer and nucleic acid to give a net molar excess of ionizable nitrogen (polymer) to phosphate (nucleic acid) over the range of 2 to 6. The electrostatic interactions between cationic polymers and nucleic acid resulted in the formation of polyplexes with average particle size distribution of about 100 nm, hence referred to here as nanoplexes. A dosage of about 100 to 200 mg of CRISPR Cas is envisioned for delivery in the self-assembling nanoparticles of Schiffelers et al.

The nanoplexes of Bartlett et al. (PNAS, Sep. 25, 2007, vol. 104, no. 39) may also be applied to the present invention. The nanoplexes of Bartlett et al. are prepared by mixing equal volumes of aqueous solutions of cationic polymer and nucleic acid to give a net molar excess of ionizable nitrogen (polymer) to phosphate (nucleic acid) over the range of 2 to 6. The electrostatic interactions between cationic polymers and nucleic acid resulted in the formation of polyplexes with average particle size distribution of about 100 nm, hence referred to here as nanoplexes. The DOTA-siRNA of Bartlett et al. was synthesized as follows: 1,4,7,10-tetraazacyclodo-decane-1,4,7,10-tetraacetic acid mono(N-hydroxysuccinimide ester) (DOTA-NHSester) was ordered from Macrocyclics (Dallas, TX). The amine modified RNA sense strand with a 100-fold molar excess of DOTA-NHS-ester in carbonate buffer (pH 9) was added to a microcentrifuge tube. The contents were reacted by stirring for 4 h at room temperature. The DOTA-RNAsense conjugate was ethanol-precipitated, resuspended in water, and annealed to the unmodified antisense strand to yield DOTA-siRNA. All liquids were pretreated with Chelex-100 (Bio-Rad, Hercules, CA) to remove trace metal contaminants. Tf-targeted and nontargeted siRNA nanoparticles may be formed by using cyclodextrin-containing polycations. Typically, nanoparticles were formed in water at a charge ratio of 3 (+/−) and an siRNA concentration of 0.5 g/liter. One percent of the adamantane-PEG molecules on the surface of the targeted nanoparticles were modified with Tf (adamantane-PEG-Tf). The nanoparticles were suspended in a 5% (wt/vol) glucose carrier solution for injection.

Davis et al. (Nature, Vol 464, 15 Apr. 2010) conducts a RNA clinical trial that uses a targeted nanoparticle-delivery system (clinical trial registration number NCT00689065). Patients with solid cancers refractory to standard-of-care therapies are administered doses of targeted nanoparticles on days 1, 3, 8 and 10 of a 21-day cycle by a 30-min intravenous infusion. The nanoparticles consist of a synthetic delivery system containing: (1) a linear, cyclodextrin-based polymer (CDP), (2) a human transferrin protein (TF) targeting ligand displayed on the exterior of the nanoparticle to engage TF receptors (TFR) on the surface of the cancer cells, (3) a hydrophilic polymer (polyethylene glycol (PEG) used to promote nanoparticle stability in biological fluids), and (4) siRNA designed to reduce the expression of the RRM2 (sequence used in the clinic was previously denoted siR2B+ 5). The TFR has long been known to be upregulated in malignant cells, and RRM2 is an established anti-cancer target. These nanoparticles (clinical version denoted as CALAA-01) have been shown to be well tolerated in multi-dosing studies in non-human primates. Although a single patient with chronic myeloid leukaemia has been administered siRNA by liposomal delivery, Davis et al.'s clinical trial is the initial human trial to systemically deliver siRNA with a targeted delivery system and to treat patients with solid cancer. To ascertain whether the targeted delivery system can provide effective delivery of functional siRNA to human tumors, Davis et al. investigated biopsies from three patients from three different dosing cohorts; patients A, B and C, all of whom had metastatic melanoma and received CALAA-01 doses of 18, 24 and 30 mg m-2 siRNA, respectively. Similar doses may also be contemplated for the CRISPR Cas system of the present invention. The delivery of the invention may be achieved with nanoparticles containing a linear, cyclodextrin-based polymer (CDP), a human transferrin protein (TF) targeting ligand displayed on the exterior of the nanoparticle to engage TF receptors (TFR) on the surface of the cancer cells and/or a hydrophilic polymer (for example, polyethylene glycol (PEG) used to promote nanoparticle stability in biological fluids).

U.S. Pat. No. 8,709,843, incorporated herein by reference, provides a drug delivery system for targeted delivery of therapeutic agent-containing particles to tissues, cells, and intracellular compartments. The invention provides targeted particles comprising polymer conjugated to a surfactant, hydrophilic polymer or lipid. U.S. Pat. No. 6,007,845, incorporated herein by reference, provides particles which have a core of a multiblock copolymer formed by covalently linking a multifunctional compound with one or more hydrophobic polymers and one or more hydrophilic polymers, and contain a biologically active material. U.S. Pat. No. 5,855,913, incorporated herein by reference, provides a particulate composition having aerodynamically light particles having a tap density of less than 0.4 g/cm3 with a mean diameter of between 5 μm and 30 μm, incorporating a surfactant on the surface thereof for drug delivery to the pulmonary system. U.S. Pat. No. 5,985,309, incorporated herein by reference, provides particles incorporating a surfactant and/or a hydrophilic or hydrophobic complex of a positively or negatively charged therapeutic or diagnostic agent and a charged molecule of opposite charge for delivery to the pulmonary system. U.S. Pat. No. 5,543,158, incorporated herein by reference, provides biodegradable injectable particles having a biodegradable solid core containing a biologically active material and poly(alkylene glycol) moieties on the surface. WO2012135025 (also published as US20120251560), incorporated herein by reference, describes conjugated polyethyleneimine (PEI) polymers and conjugated aza-macrocycles (collectively referred to as "conjugated lipomer" or "lipomers"). In certain embodiments, it can envisioned that such conjugated lipomers can be used in the context of the CRISPR-Cas system to achieve in vitro, ex vivo and in vivo genomic perturbations to modify gene expression, including modulation of protein expression.

In one embodiment, the nanoparticle may be epoxide-modified lipid-polymer, advantageously 7C1 (see, e.g., James E. Dahlman and Carmen Barnes et al. Nature Nanotechnology (2014) published online 11 May 2014, doi: 10.1038/nnano.2014.84). C71 was synthesized by reacting C15 epoxide-terminated lipids with PEI600 at a 14:1 molar ratio, and was formulated with C14PEG2000 to produce nanoparticles (diameter between 35 and 60 nm) that were stable in PBS solution for at least 40 days.

An epoxide-modified lipid-polymer may be utilized to deliver the CRISPR-Cas system of the present invention to pulmonary, cardiovascular or renal cells, however, one of skill in the art may adapt the system to deliver to other target organs. Dosage ranging from about 0.05 to about 0.6 mg/kg are envisioned. Dosages over several days or weeks are also envisioned, with a total dosage of about 2 mg/kg.

In some embodiments, the LNP for delivering the RNA molecules is prepared by methods known in the art, such as those described in, for example, WO 2005/105152 (PCT/EP2005/004920), WO 2006/069782 (PCT/EP2005/014074), WO 2007/121947 (PCT/EP2007/003496), and WO 2015/082080 (PCT/EP2014/003274), which are herein incorporated by reference. LNPs aimed specifically at the enhanced and improved delivery of siRNA into mammalian cells are described in, for example, Aleku et al., Cancer Res., 68(23): 9788-98 (Dec. 1, 2008), Strumberg et al., Int. J. Clin. Pharmacol. Ther., 50(1): 76-8 (January 2012), Schultheis et al., J. Clin. Oncol., 32(36): 4141-48 (Dec. 20, 2014), and Fehring et al., Mol. Ther., 22(4): 811-20 (Apr. 22, 2014), which are herein incorporated by reference and may be applied to the present technology.

In some embodiments, the LNP includes any LNP disclosed in WO 2005/105152 (PCT/EP2005/004920), WO 2006/069782 (PCT/EP2005/014074), WO 2007/121947 (PCT/EP2007/003496), and WO 2015/082080 (PCT/EP2014/003274).

In some embodiments, the LNP includes at least one lipid having Formula I:
(Formula I), wherein R1 and R2 are each and independently selected from the group comprising alkyl, n is any integer between 1 and 4, and R3 is an acyl selected from the group comprising lysyl, ornithyl, 2,4-di-aminobutyryl, histidyl and an acyl moiety according to Formula II:

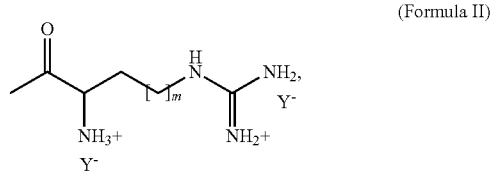

(Formula II)

wherein m is any integer from 1 to 3 and $Y^-$ is a pharmaceutically acceptable anion. In some embodiments, a lipid according to Formula I includes at least two asymmetric C atoms. In some embodiments, enantiomers of Formula I include, but are not limited to, R—R; S—S; R—S and S—R enantiomer.

In some embodiments, R1 is lauryl and R2 is myristyl. In another embodiment, R1 is palmityl and R2 is oleyl. In some embodiments, m is 1 or 2. In some embodiments, Y– is selected from halogenids, acetate or trifluoroacetate.

In some embodiments, the LNP comprises one or more lipids select from:
-arginyl-2,3-diamino propionic acid-N-palmityl-N-oleyl-amide trihydrochloride (Formula III)

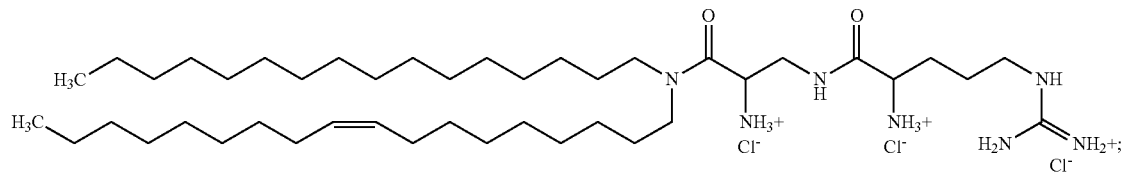

(Formula III)

-arginyl-2,3-diamino propionic acid-N-lauryl-N-myristyl-amide trihydrochloride (Formula IV)

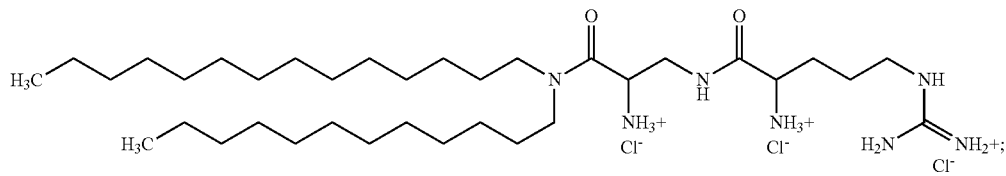

(Formula IV)

and -arginyl-lysine-N-lauryl-N-myristyl-amide trihydrochloride (Formula V):

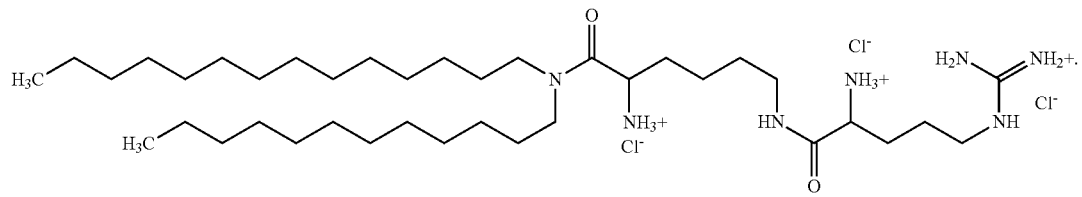

(Formula V)

In some embodiments, the LNP also includes a constituent. By way of example, but not by way of limitation, in some embodiments, the constituent is selected from peptides, proteins, oligonucleotides, polynucleotides, nucleic acids, or a combination thereof. In some embodiments, the constituent is an antibody, e.g., a monoclonal antibody. In some embodiments, the constituent is a nucleic acid selected from, e.g., ribozymes, aptamers, spiegelmers, DNA, RNA, PNA, LNA, or a combination thereof. In some embodiments, the nucleic acid is guide RNA and/or mRNA.

In some embodiments, the constituent of the LNP comprises an mRNA encoding a CRIPSR-Cas protein. In some embodiments, the constituent of the LNP comprises an mRNA encoding a Type-II or Type-V CRIPSR-Cas protein. In some embodiments, the constituent of the LNP comprises an mRNA encoding an adenosine deaminase (which may be fused to a CRISPR-Cas protein or an adaptor protein).

In some embodiments, the constituent of the LNP further comprises one or more guide RNA. In some embodiments, the LNP is configured to deliver the aforementioned mRNA and guide RNA to vascular endothelium. In some embodiments, the LNP is configured to deliver the aforementioned mRNA and guide RNA to pulmonary endothelium. In some embodiments, the LNP is configured to deliver the aforementioned mRNA and guide RNA to liver. In some embodiments, the LNP is configured to deliver the aforementioned mRNA and guide RNA to lung. In some embodiments, the LNP is configured to deliver the aforementioned mRNA and guide RNA to hearts. In some embodiments, the LNP is configured to deliver the aforementioned mRNA and guide RNA to spleen. In some embodiments, the LNP is configured to deliver the aforementioned mRNA and guide RNA to kidney. In some embodiments, the LNP is configured to deliver the aforementioned mRNA and guide RNA to pancreas. In some embodiments, the LNP is configured to deliver the aforementioned mRNA and guide RNA to brain. In some embodiments, the LNP is configured to deliver the aforementioned mRNA and guide RNA to macrophages.

In some embodiments, the LNP also includes at least one helper lipid. In some embodiments, the helper lipid is selected from phospholipids and steroids. In some embodiments, the phospholipids are di- and/or monoester of the phosphoric acid. In some embodiments, the phospholipids are phosphoglycerides and/or sphingolipids. In some embodiments, the steroids are naturally occurring and/or synthetic compounds based on the partially hydrogenated cyclopenta[a]phenanthrene. In some embodiments, the steroids contain 21 to 30 C atoms. In some embodiments, the steroid is cholesterol. In some embodiments, the helper lipid is selected from 1,2-diphytanoyl-sn-glycero-3-phosphoethanolamine (DPhyPE), ceramide, and 1,2-dioleoylsn-glycero-3-phosphoethanolamine (DOPE).

In some embodiments, the at least one helper lipid comprises a moiety selected from the group comprising a PEG moiety, a HEG moiety, a polyhydroxyethyl starch (polyHES) moiety and a polypropylene moiety. In some embodiments, the moiety has a molecule weight between about 500 to 10,000 Da or between about 2,000 to 5,000 Da. In some embodiments, the PEG moiety is selected from 1,2-distearoyl-sn-glycero-3 phosphoethanolamine, 1,2-dialkyl-sn-glycero-3-phosphoethanolamine, and Ceramide-PEG. In some embodiments, the PEG moiety has a molecular weight between about 500 to 10,000 Da or between about 2,000 to 5,000 Da. In some embodiments, the PEG moiety has a molecular weight of 2,000 Da.

In some embodiments, the helper lipid is between about 20 mol % to 80 mol % of the total lipid content of the composition. In some embodiments, the helper lipid component is between about 35 mol % to 65 mol % of the total lipid content of the LNP. In some embodiments, the LNP includes lipids at 50 mol % and the helper lipid at 50 mol % of the total lipid content of the LNP.

In some embodiments, the LNP includes any of -3-arginyl-2,3-diaminopropionic acid-N-palmityl-N-oleyl-amide trihydrochloride, -arginyl-2,3-diaminopropionic acid-N-lauryl-N-myristyl-amide trihydrochloride or -arginyl-lysine-N-lauryl-N-myristyl-amide trihydrochloride in combination with DPhyPE, wherein the content of DPhyPE is about 80 mol %, 65 mol %, 50 mol % and 35 mol % of the overall lipid content of the LNP. In some embodiments, the LNP includes -arginyl-2,3-diamino propionic acid-N-pahnityl-N-oleyl-amide trihydrochloride (lipid) and 1,2-diphytanoyl-sn-glycero-3-phosphoethanolamine (helper lipid). In some embodiments, the LNP includes -arginyl-2,3-diamino propionic acid-N-palmityl-N-oleyl-amide trihydrochloride (lipid), 1,2-diphytanoyl-sn-glycero-3-phosphoethanolamine (first helper lipid), and 1,2-disteroyl-sn-glycero-3-phosphoethanolamine-PEG2000 (second helper lipid).

In some embodiments, the second helper lipid is between about 0.05 mol % to 4.9 mol % or between about 1 mol % to 3 mol % of the total lipid content. In some embodiments, the LNP includes lipids at between about 45 mol % to 50 mol % of the total lipid content, a first helper lipid between about 45 mol % to 50 mol % of the total lipid content, under the proviso that there is a PEGylated second helper lipid between about 0.1 mol % to 5 mol %, between about 1 mol % to 4 mol %, or at about 2 mol % of the total lipid content, wherein the sum of the content of the lipids, the first helper lipid, and of the second helper lipid is 100 mol % of the total lipid content and wherein the sum of the first helper lipid and the second helper lipid is 50 mol % of the total lipid content. In some embodiments, the LNP comprises: (a) 50 mol % of -arginyl-2,3-diamino propionic acid-N-palmityl-N-oleyl-amide trihydrochloride, 48 mol % of 1,2-diphytanoyl-sn-glycero-3-phosphoethanolamine; and 2 mol % 1,2-distearoyl-sn-glycero-3-phosphoethanolamine-PEG2000; or (b) 50 mol % of -arginyl-2,3-diamino propionic acid-N-palmityl-N-oleyl-amide trihydrochloride, 49 mol % 1,2-diphytanoyl-sn-glycero-3-phosphoethanolamine; and 1 mol % N(Carbonyl-methoxypolyethylenglycol-2000)-1,2-distearoyl-sn-glycero3-phosphoethanolamine, or a sodium salt thereof.

In some embodiments, the LNP contains a nucleic acid, wherein the charge ratio of nucleic acid backbone phosphates to cationic lipid nitrogen atoms is about 1:1.5-7 or about 1:4.

In some embodiments, the LNP also includes a shielding compound, which is removable from the lipid composition under in vivo conditions. In some embodiments, the shielding compound is a biologically inert compound. In some embodiments, the shielding compound does not carry any charge on its surface or on the molecule as such. In some embodiments, the shielding compounds are polyethyleneglycoles (PEGs), hydroxyethylglucose (HEG) based polymers, polyhydroxyethyl starch (polyHES) and polypropylene. In some embodiments, the PEG, HEG, polyHES, and a polypropylene weight between about 500 to 10,000 Da or between about 2000 to 5000 Da. In some embodiments, the shielding compound is PEG2000 or PEG5000.

In some embodiments, the LNP includes at least one lipid, a first helper lipid, and a shielding compound that is removable from the lipid composition under in vivo conditions. In some embodiments, the LNP also includes a second helper lipid. In some embodiments, the first helper lipid is ceramide. In some embodiments, the second helper lipid is ceramide. In some embodiments, the ceramide comprises at least one short carbon chain substituent of from 6 to 10 carbon atoms. In some embodiments, the ceramide comprises 8 carbon atoms. In some embodiments, the shielding compound is attached to a ceramide. In some embodiments, the shielding compound is attached to a ceramide. In some embodiments, the shielding compound is covalently attached to the ceramide. In some embodiments, the shielding compound is attached to a nucleic acid in the LNP. In some embodiments, the shielding compound is covalently attached to the nucleic acid. In some embodiments, the shielding compound is attached to the nucleic acid by a linker. In some embodiments, the linker is cleaved under physiological conditions. In some embodiments, the linker is selected from ssRNA, ssDNA, dsRNA, dsDNA, peptide, S—S-linkers and pH sensitive linkers. In some embodiments, the linker moiety is attached to the 3' end of the sense strand of the nucleic acid. In some embodiments, the shielding compound comprises a pH-sensitive linker or a pH-sensitive moiety. In some embodiments, the pH-sensitive linker or pH-sensitive moiety is an anionic linker or an anionic moiety. In some embodiments, the anionic linker or anionic moiety is less anionic or neutral in an acidic environment. In some embodiments, the pH-sensitive linker or the pH-sensitive moiety is selected from the oligo (glutamic acid), oligophenolate(s) and diethylene triamine penta acetic acid.

In any of the LNP embodiments in the previous paragraph, the LNP can have an osmolality between about 50 to 600 mosmole/kg, between about 250 to 350 mosmole/kg, or between about 280 to 320 mosmole/kg, and/or wherein the LNP formed by the lipid and/or one or two helper lipids and the shielding compound have a particle size between about 20 to 200 nm, between about 30 to 100 nm, or between about 40 to 80 nm.

In some embodiments, the shielding compound provides for a longer circulation time in vivo and allows for a better biodistribution of the nucleic acid containing LNP. In some embodiments, the shielding compound prevents immediate interaction of the LNP with serum compounds or compounds of other bodily fluids or cytoplasma membranes, e.g., cytoplasma membranes of the endothelial lining of the vasculature, into which the LNP is administered. Additionally or alternatively, in some embodiments, the shielding compounds also prevent elements of the immune system from immediately interacting with the LNP. Additionally or alternatively, in some embodiments, the shielding compound acts as an anti-opsonizing compound. Without wishing to be bound by any mechanism or theory, in some embodiments, the shielding compound forms a cover or coat that reduces the surface area of the LNP available for interaction with its environment. Additionally or alternatively, in some embodiments, the shielding compound shields the overall charge of the LNP.

In another embodiment, the LNP includes at least one cationic lipid having Formula VI:

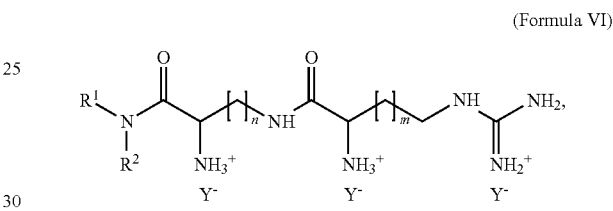

(Formula VI)

wherein n is 1, 2, 3, or 4, wherein m is 1, 2, or 3, wherein $Y^-$ is anion, wherein each of $R^1$ and $R^2$ is individually and independently selected from the group consisting of linear C12-C18 alkyl and linear C12-C18 alkenyl, a sterol compound, wherein the sterol compound is selected from the group consisting of cholesterol and stigmasterol, and a PEGylated lipid, wherein the PEGylated lipid comprises a PEG moiety, wherein the PEGylated lipid is selected from the group consisting of:

a PEGylated phosphoethanolamine of Formula VII:

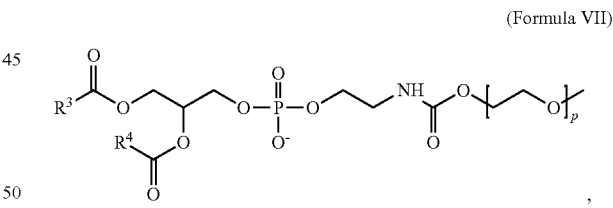

(Formula VII)

wherein $R^3$ and $R^4$ are individually and independently linear C13-C17 alkyl, and p is any integer between 15 to 130;

a PEGylated ceramide of Formula VIII:

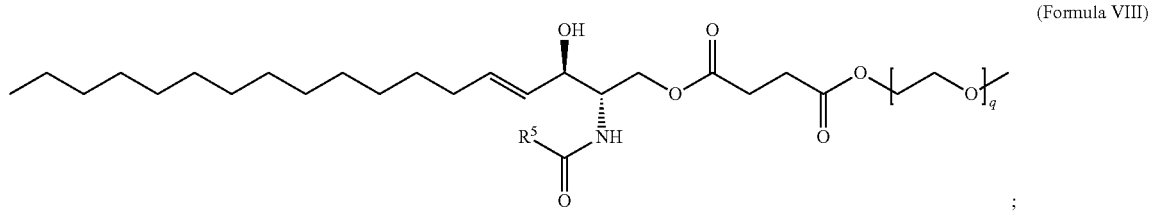

(Formula VIII)

;

wherein R⁵ is linear C7-C15 alkyl, and q is any number between 15 to 130; and
a PEGylated diacylglycerol of Formula IX:

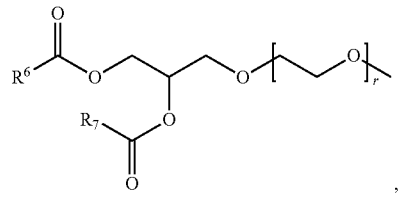

(Formula IX)

wherein each of R⁶ and R⁷ is individually and independently linear C11-C17 alkyl, and r is any integer from 15 to 130.

In some embodiments, R¹ and R² are different from each other. In some embodiments, R¹ is palmityl and R² is oleyl. In some embodiments, R¹ is lauryl and R² is myristyl. In some embodiments, R¹ and R² are the same. In some embodiments, each of R¹ and R² is individually and independently selected from the group consisting of C12 alkyl, C14 alkyl, C16 alkyl, C18 alkyl, C12 alkenyl, C14 alkenyl, C16 alkenyl and C18 alkenyl. In some embodiments, each of C12 alkenyl, C14 alkenyl, C16 alkenyl and C18 alkenyl comprises one or two double bonds. In some embodiments, C18 alkenyl is C18 alkenyl with one double bond between C9 and C10. In some embodiments, C18 alkenyl is cis-9-octadecyl.

In some embodiments, the cationic lipid is a compound of Formula X:

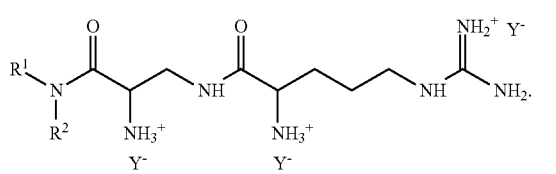

(Formula X)

In some embodiments, Y⁻ is selected from halogenids, acetate and trifluoroacetate. In some embodiments, the cationic lipid is -arginyl-2,3-diamino propionic acid-N-palmityl-N-oleyl-amide trihydrochloride of Formula III:

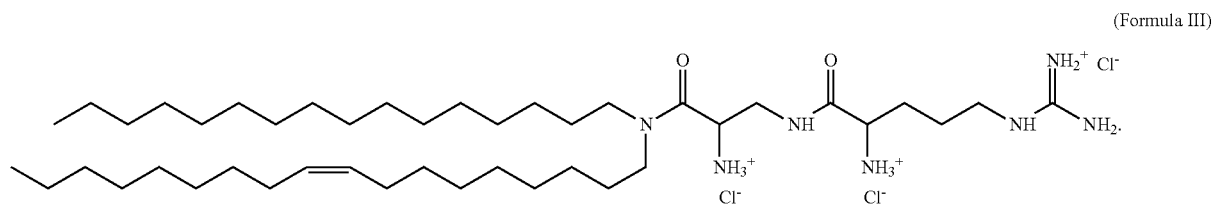 [SMILES: CCCCCCCC/C=C\CCCCCCCCN(CCCCCCCCCCCCCCCC)C(=O)C([NH3+])CNC(=O)C([NH3+])CCCNC(N)=[NH2+] ; [Cl-] ; [Cl-] ; [Cl-]]

(Formula III)

In some embodiments, the cationic lipid is -arginyl-2,3-diamino propionic acid-N-lauryl-N-myristyl-amide trihydrochloride of Formula IV:

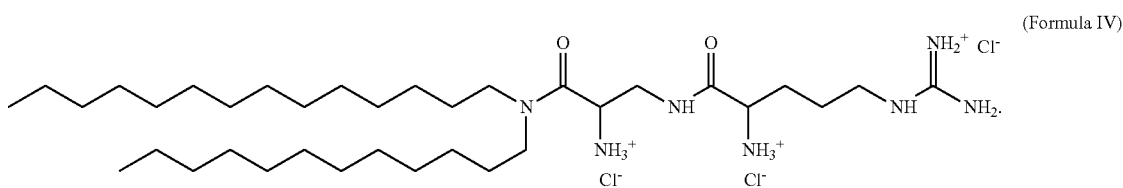 [SMILES: CCCCCCCCCCCCCCN(CCCCCCCCCCCC)C(=O)C([NH3+])CNC(=O)C([NH3+])CCCNC(N)=[NH2+] ; [Cl-] ; [Cl-] ; [Cl-]]

(Formula IV)

In some embodiments, the cationic lipid is -arginyl-lysine-N-lauryl-N-myristyl-amide trihydrochloride of Formula V:

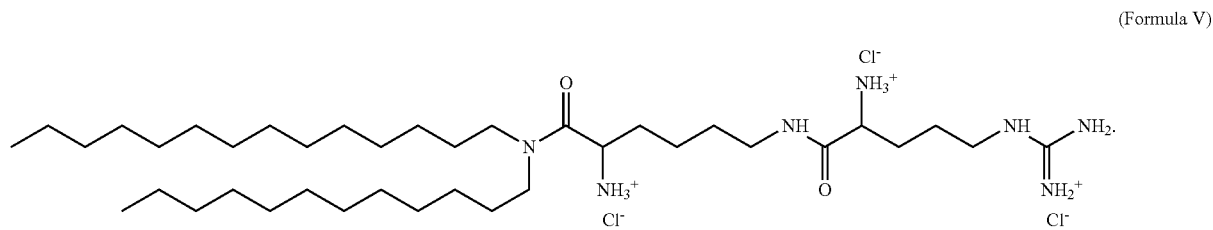 [SMILES: [Cl-] ; CCCCCCCCCCCCCCN(CCCCCCCCCCCC)C(=O)C([NH3+])CCCCNC(=O)C([NH3+])CCCNC(N)=[NH2+] ; [Cl-] ; [Cl-]]

(Formula V)

In some embodiments, the sterol compound is cholesterol. In some embodiments, the sterol compound is stigmasterin.

In some embodiments, the PEG moiety of the PEGylated lipid has a molecular weight from about 800 to 5,000 Da. In some embodiments, the molecular weight of the PEG moiety of the PEGylated lipid is about 800 Da. In some embodiments, the molecular weight of the PEG moiety of the PEGylated lipid is about 2,000 Da. In some embodiments, the molecular weight of the PEG moiety of the PEGylated lipid is about 5,000 Da. In some embodiments, the PEGylated lipid is a PEGylated phosphoethanolamine of Formula VII, wherein each of $R^3$ and $R^4$ is individually and independently linear C13-C17 alkyl, and p is any integer from 18, 19 or 20, or from 44, 45 or 46 or from 113, 114 or 115. In some embodiments, $R^3$ and $R^4$ are the same. In some embodiments, $R^3$ and $R^4$ are different. In some embodiments, each of $R^3$ and $R^4$ is individually and independently selected from the group consisting of C13 alkyl, C15 alkyl and C17 alkyl. In some embodiments, the PEGylated phosphoethanolamine of Formula VII is 1,2-distearoyl-sn-glycero-3-phosphoethanolamine-N-[methoxy(polyethylene glycol)-2000](ammonium salt):

(Formula XI)

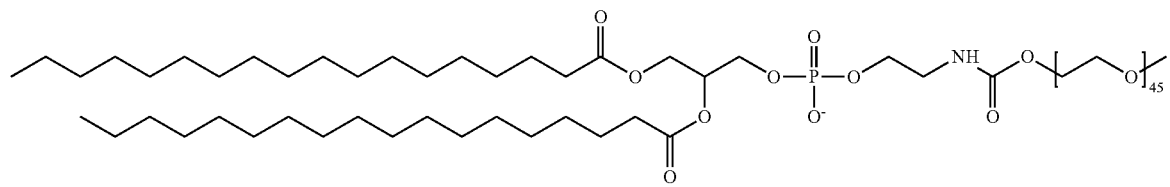

In some embodiments, the PEGylated phosphoethanolamine of Formula VII is 1,2-distearoyl-sn-glycero-3-phosphoethanolamine-N-[methoxy(polyethylene glycol)-5000](ammonium salt):

(Formula XII)

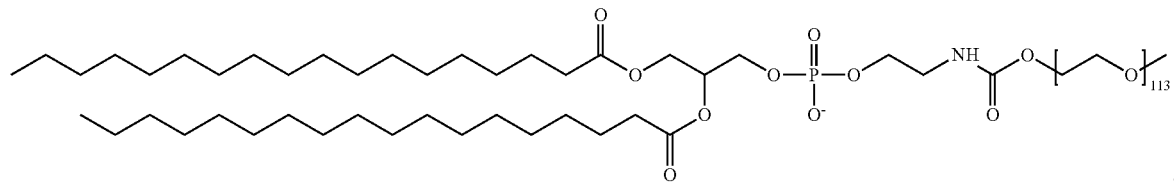

In some embodiments, the PEGylated lipid is a PEGylated ceramide of Formula VIII, wherein $R^5$ is linear C7-C15 alkyl, and q is any integer from 18, 19 or 20, or from 44, 45 or 46 or from 113, 114 or 115. In some embodiments, $R^5$ is linear C7 alkyl. In some embodiments, $R^5$ is linear C15 alkyl. In some embodiments, the PEGylated ceramide of Formula VIII is N-octanoyl-sphingosine-1-{succinyl[methoxy(polyethylene glycol)2000]}:

(Formula XIII)

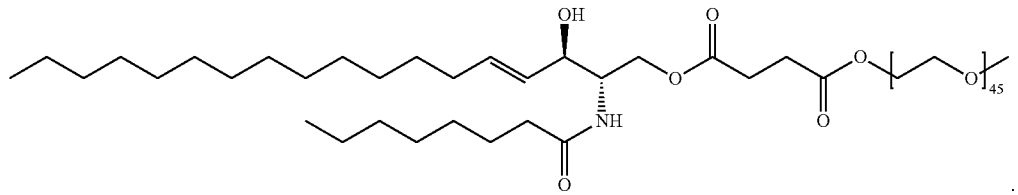

In some embodiments, the PEGylated ceramide of Formula VIII is N-palmitoyl-sphingosine-1-{succinyl[methoxy(polyethylene glycol)2000]}

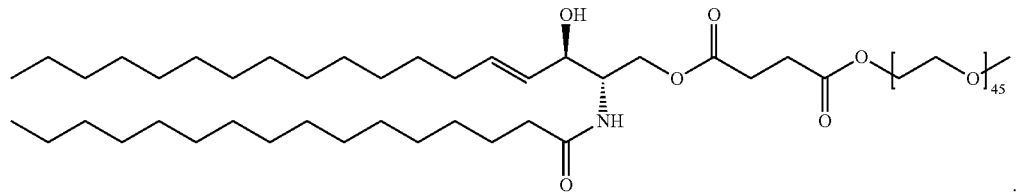
(Formula XIV)

In some embodiments, the PEGylated lipid is a PEGylated diacylglycerol of Formula IX, wherein each of $R^6$ and $R^7$ is individually and independently linear C11-C17 alkyl, and r is any integer from 18, 19 or 20, or from 44, 45 or 46 or from 113, 114 or 115. In some embodiments, $R^6$ and $R^7$ are the same. In some embodiments, $R^6$ and $R^7$ are different. In some embodiments, each of $R^6$ and $R^7$ is individually and independently selected from the group consisting of linear C17 alkyl, linear C15 alkyl and linear C13 alkyl. In some embodiments, the PEGylated diacylglycerol of Formula IX 1,2-Distearoyl-sn-glycerol [methoxy(polyethylene glycol)2000]:

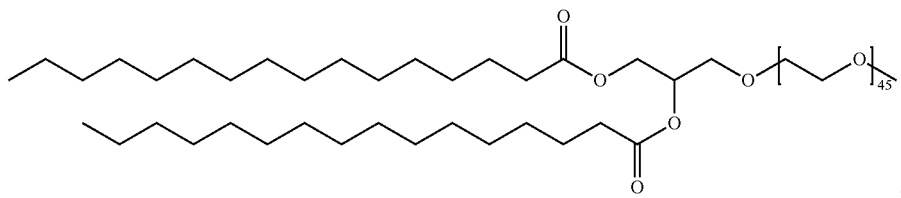
(Formula XV)

In some embodiments, the PEGylated diacylglycerol of Formula IX is 1,2-Dipalmitoyl-sn-glycerol [methoxy(polyethylene glycol)2000]:

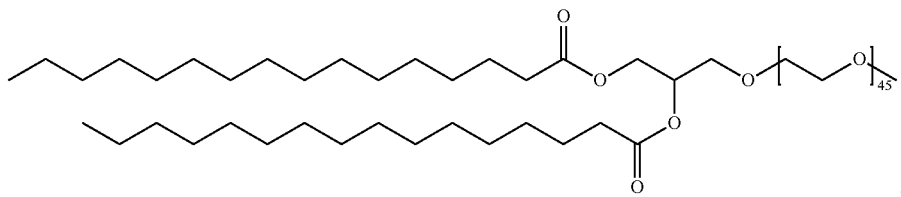
(Formula XVI)

In some embodiments, the PEGylated diacylglycerol of Formula IX is:

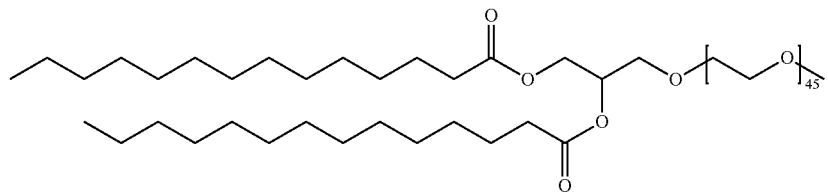
(Formula XVII)

In some embodiments, the LNP includes at least one cationic lipid selected from of Formulas III, IV, and V, at least one sterol compound selected from a cholesterol and stigmasterin, and wherein the PEGylated lipid is at least one selected from Formulas XI and XII. In some embodiments, the LNP includes at least one cationic lipid selected from Formulas III, IV, and V, at least one sterol compound selected from a cholesterol and stigmasterin, and wherein the PEGylated lipid is at least one selected from Formulas XIII and XIV. In some embodiments, the LNP includes at least one cationic lipid selected from Formulas III, IV, and V, at least one sterol compound selected from a cholesterol and stigmasterin, and wherein the PEGylated lipid is at least one selected from Formulas XV and XVI. In some embodiments, the LNP includes a cationic lipid of Formula III, a cholesterol as the sterol compound, and wherein the PEGylated lipid is Formula XI.

In any of the LNP embodiments in the previous paragraph, wherein the content of the cationic lipid composition is between about 65 mole % to 75 mole %, the content of the sterol compound is between about 24 mole % to 34 mole % and the content of the PEGylated lipid is between about 0.5 mole % to 1.5 mole %, wherein the sum of the content of the cationic lipid, of the sterol compound and of the PEGylated lipid for the lipid composition is 100 mole %. In some embodiments, the cationic lipid is about 70 mole %, the content of the sterol compound is about 29 mole % and the content of the PEGylated lipid is about 1 mole %. In some embodiments, the LNP is 70 mole % of Formula III, 29 mole % of cholesterol, and 1 mole % of Formula XI.

Exosomes

Exosomes are endogenous nano-vesicles that transport RNAs and proteins, and which can deliver RNA to the brain and other target organs. To reduce immunogenicity, Alvarez-Erviti et al. (2011, Nat Biotechnol 29: 341) used self-derived dendritic cells for exosome production. Targeting to the brain was achieved by engineering the dendritic cells to express Lamp2b, an exosomal membrane protein, fused to the neuron-specific RVG peptide. Purified exosomes were loaded with exogenous RNA by electroporation. Intravenously injected RVG-targeted exosomes delivered GAPDH siRNA specifically to neurons, microglia, oligodendrocytes in the brain, resulting in a specific gene knockdown. Pre-exposure to RVG exosomes did not attenuate knockdown, and non-specific uptake in other tissues was not observed. The therapeutic potential of exosome-mediated siRNA delivery was demonstrated by the strong mRNA (60%) and protein (62%) knockdown of BACE1, a therapeutic target in Alzheimer's disease.

To obtain a pool of immunologically inert exosomes, Alvarez-Erviti et al. harvested bone marrow from inbred C57BL/6 mice with a homogenous major histocompatibility complex (MHC) haplotype. As immature dendritic cells produce large quantities of exosomes devoid of T-cell activators such as MHC-II and CD86, Alvarez-Erviti et al. selected for dendritic cells with granulocyte/macrophage-colony stimulating factor (GM-CSF) for 7 d. Exosomes were purified from the culture supernatant the following day using well-established ultracentrifugation protocols. The exosomes produced were physically homogenous, with a size distribution peaking at 80 nm in diameter as determined by nanoparticle tracking analysis (NTA) and electron microscopy. Alvarez-Erviti et al. obtained 6-12 μg of exosomes (measured based on protein concentration) per 106 cells.

Next, Alvarez-Erviti et al. investigated the possibility of loading modified exosomes with exogenous cargoes using electroporation protocols adapted for nanoscale applications. As electroporation for membrane particles at the nanometer scale is not well-characterized, nonspecific Cy5-labeled RNA was used for the empirical optimization of the electroporation protocol. The amount of encapsulated RNA was assayed after ultracentrifugation and lysis of exosomes. Electroporation at 400 V and 125 μF resulted in the greatest retention of RNA and was used for all subsequent experiments.

Alvarez-Erviti et al. administered 150 μg of each BACE1 siRNA encapsulated in 150 μg of RVG exosomes to normal C57BL/6 mice and compared the knockdown efficiency to four controls: untreated mice, mice injected with RVG exosomes only, mice injected with BACE1 siRNA complexed to an in vivo cationic liposome reagent and mice injected with BACE1 siRNA complexed to RVG-9R, the RVG peptide conjugated to 9 D-arginines that electrostatically binds to the siRNA. Cortical tissue samples were analyzed 3 d after administration and a significant protein knockdown (45%, $P<0.05$, versus 62%, $P<0.01$) in both siRNA-RVG-9R-treated and siRNARVG exosome-treated mice was observed, resulting from a significant decrease in BACE1 mRNA levels (66% [+ or -] 15%, $P<0.001$ and 61% [+ or -] 13% respectively, $P<0.01$). Moreover, Applicants demonstrated a significant decrease (55%, $P<0.05$) in the total [beta]-amyloid 1-42 levels, a main component of the amyloid plaques in Alzheimer's pathology, in the RVG-exosome-treated animals. The decrease observed was greater than the 0-amyloid 1-40 decrease demonstrated in normal mice after intraventricular injection of BACE1 inhibitors. Alvarez-Erviti et al. carried out 5'-rapid amplification of cDNA ends (RACE) on BACE1 cleavage product, which provided evidence of RNAi-mediated knockdown by the siRNA.

Finally, Alvarez-Erviti et al. investigated whether RNA-RVG exosomes induced immune responses in vivo by assessing IL-6, IP-10, TNFα and IFN-α serum concentrations. Following exosome treatment, nonsignificant changes in all cytokines were registered similar to siRNA-transfection reagent treatment in contrast to siRNA-RVG-9R, which potently stimulated IL-6 secretion, confirming the immunologically inert profile of the exosome treatment. Given that exosomes encapsulate only 20% of siRNA, delivery with RVG-exosome appears to be more efficient than RVG-9R delivery as comparable mRNA knockdown and greater protein knockdown was achieved with fivefold less siRNA without the corresponding level of immune stimulation. This experiment demonstrated the therapeutic potential of RVG-exosome technology, which is potentially suited for long-term silencing of genes related to neurodegenerative diseases. The exosome delivery system of Alvarez-Erviti et al. may be applied to deliver the AD-functionalized CRISPR-Cas system of the present invention to therapeutic targets, especially neurodegenerative diseases. A dosage of about 100 to 1000 mg of CRISPR Cas encapsulated in about 100 to 1000 mg of RVG exosomes may be contemplated for the present invention.

El-Andaloussi et al. (Nature Protocols 7, 2112-2126 (2012)) discloses how exosomes derived from cultured cells can be harnessed for delivery of RNA in vitro and in vivo. This protocol first describes the generation of targeted exosomes through transfection of an expression vector, comprising an exosomal protein fused with a peptide ligand. Next, El-Andaloussi et al. explain how to purify and characterize exosomes from transfected cell supernatant. Next, El-Andaloussi et al. detail crucial steps for loading RNA into exosomes. Finally, El-Andaloussi et al. outline how to use exosomes to efficiently deliver RNA in vitro and in vivo in mouse brain. Examples of anticipated results in which exosome-mediated RNA delivery is evaluated by functional assays and imaging are also provided. The entire protocol takes ~3 weeks. Delivery or administration according to the invention may be performed using exosomes produced from self-derived dendritic cells. From the herein teachings, this can be employed in the practice of the invention.

In another embodiment, the plasma exosomes of Wahlgren et al. (Nucleic Acids Research, 2012, Vol. 40, No. 17 e130) are contemplated. Exosomes are nano-sized vesicles (30-90 nm in size) produced by many cell types, including dendritic cells (DC), B cells, T cells, mast cells, epithelial cells and tumor cells. These vesicles are formed by inward budding of late endosomes and are then released to the extracellular environment upon fusion with the plasma membrane. Because exosomes naturally carry RNA between cells, this property may be useful in gene therapy, and from this disclosure can be employed in the practice of the instant invention.

Exosomes from plasma can be prepared by centrifugation of buffy coat at 900 g for 20 min to isolate the plasma followed by harvesting cell supernatants, centrifuging at 300 g for 10 min to eliminate cells and at 16 500 g for 30 min followed by filtration through a 0.22 mm filter. Exosomes are pelleted by ultracentrifugation at 120 000 g for 70 min. Chemical transfection of siRNA into exosomes is carried out according to the manufacturer's instructions in RNAi Human/Mouse Starter Kit (Quiagen, Hilden, Germany). siRNA is added to 100 ml PBS at a final concentration of 2 mmol/ml. After adding HiPerFect transfection reagent, the mixture is incubated for 10 min at RT. In order to remove the excess of micelles, the exosomes are re-isolated using aldehyde/sulfate latex beads. The chemical transfection of CRISPR Cas into exosomes may be conducted similarly to siRNA. The exosomes may be co-cultured with monocytes and lymphocytes isolated from the peripheral blood of healthy donors. Therefore, it may be contemplated that exosomes containing CRISPR Cas may be introduced to monocytes and lymphocytes of and autologously reintroduced into a human. Accordingly, delivery or administration according to the invention may be performed using plasma exosomes.

Liposomes

Delivery or administration according to the invention can be performed with liposomes. Liposomes are spherical vesicle structures composed of a uni- or multilamellar lipid bilayer surrounding internal aqueous compartments and a relatively impermeable outer lipophilic phospholipid bilayer. Liposomes have gained considerable attention as drug delivery carriers because they are biocompatible, nontoxic, can deliver both hydrophilic and lipophilic drug molecules, protect their cargo from degradation by plasma enzymes, and transport their load across biological membranes and the blood brain barrier (BBB) (see, e.g., Spuch and Navarro, Journal of Drug Delivery, vol. 2011, Article ID 469679, 12 pages, 2011. doi:10.1155/2011/469679 for review).

Liposomes can be made from several different types of lipids; however, phospholipids are most commonly used to generate liposomes as drug carriers. Although liposome formation is spontaneous when a lipid film is mixed with an aqueous solution, it can also be expedited by applying force in the form of shaking by using a homogenizer, sonicator, or an extrusion apparatus (see, e.g., Spuch and Navarro, Journal of Drug Delivery, vol. 2011, Article ID 469679, 12 pages, 2011. doi:10.1155/2011/469679 for review).

Several other additives may be added to liposomes in order to modify their structure and properties. For instance, either cholesterol or sphingomyelin may be added to the liposomal mixture in order to help stabilize the liposomal structure and to prevent the leakage of the liposomal inner cargo. Further, liposomes are prepared from hydrogenated egg phosphatidylcholine or egg phosphatidylcholine, cholesterol, and dicetyl phosphate, and their mean vesicle sizes were adjusted to about 50 and 100 nm. (see, e.g., Spuch and Navarro, Journal of Drug Delivery, vol. 2011, Article ID 469679, 12 pages, 2011. doi:10.1155/2011/469679 for review).

A liposome formulation may be mainly comprised of natural phospholipids and lipids such as 1,2-distearoyl-sn-glycero-3-phosphatidyl choline (DSPC), sphingomyelin, egg phosphatidylcholines and monosialoganglioside. Since this formulation is made up of phospholipids only, liposomal formulations have encountered many challenges, one of the ones being the instability in plasma. Several attempts to overcome these challenges have been made, specifically in the manipulation of the lipid membrane. One of these attempts focused on the manipulation of cholesterol. Addition of cholesterol to conventional formulations reduces rapid release of the encapsulated bioactive compound into the plasma or 1,2-dioleoyl-sn-glycero-3-phosphoethanolamine (DOPE) increases the stability (see, e.g., Spuch and Navarro, Journal of Drug Delivery, vol. 2011, Article ID 469679, 12 pages, 2011. doi:10.1155/2011/469679 for review).

In a particularly advantageous embodiment, Trojan Horse liposomes (also known as Molecular Trojan Horses) are desirable and protocols may be found at cshprotocols.cshlp.org/content/2010/4/pdb.prot5407.long. These particles allow delivery of a transgene to the entire brain after an intravascular injection. Without being bound by limitation, it is believed that neutral lipid particles with specific antibodies conjugated to surface allow crossing of the blood brain barrier via endocytosis. Trojan Horse Liposomes may be used to deliver the CRISPR family of nucleases to the brain via an intravascular injection, which would allow whole brain transgenic animals without the need for embryonic manipulation. About 1-5 g of DNA or RNA may be contemplated for in vivo administration in liposomes.

In another embodiment, the AD-functionalized CRISPR Cas system or components thereof may be administered in liposomes, such as a stable nucleic-acid-lipid particle (SNALP) (see, e.g., Morrissey et al., Nature Biotechnology, Vol. 23, No. 8, August 2005). Daily intravenous injections of about 1, 3 or 5 mg/kg/day of a specific CRISPR Cas targeted in a SNALP are contemplated. The daily treatment may be over about three days and then weekly for about five weeks. In another embodiment, a specific CRISPR Cas encapsulated SNALP) administered by intravenous injection to at doses of about 1 or 2.5 mg/kg are also contemplated (see, e.g., Zimmerman et al., Nature Letters, Vol. 441, 4 May 2006). The SNALP formulation may contain the lipids 3-N-[(methoxypoly(ethylene glycol) 2000) carbamoyl]-1,2-dimyristyloxy-propylamine (PEG-C-DMA), 1,2-dilinoleyloxy-N,N-dimethyl-3-aminopropane (DLinDMA), 1,2-distearoyl-sn-glycero-3-phosphocholine (DSPC) and cholesterol, in a 2:40:10:48 molar percent ratio (see, e.g., Zimmerman et al., Nature Letters, Vol. 441, 4 May 2006).

In another embodiment, stable nucleic-acid-lipid particles (SNALPs) have proven to be effective delivery molecules to highly vascularized HepG2-derived liver tumors but not in poorly vascularized HCT-116 derived liver tumors (see, e.g., Li, Gene Therapy (2012) 19, 775-780). The SNALP liposomes may be prepared by formulating D-Lin-DMA and PEG-C-DMA with distearoylphosphatidylcholine (DSPC), Cholesterol and siRNA using a 25:1 lipid/siRNA ratio and a 48/40/10/2 molar ratio of Cholesterol/D-Lin-DMA/DSPC/PEG-C-DMA. The resulted SNALP liposomes are about 80-100 nm in size.

In yet another embodiment, a SNALP may comprise synthetic cholesterol (Sigma-Aldrich, St Louis, MO, USA), dipalmitoylphosphatidylcholine (Avanti Polar Lipids, Alabaster, AL, USA), 3-N-[(w-methoxy poly(ethylene glycol) 2000)carbamoyl]-1,2-dimyrestyloxypropylamine, and cationic 1,2-dilinoleyloxy-3-N,Ndimethylaminopropane (see, e.g., Geisbert et al., Lancet 2010; 375: 1896-905). A dosage of about 2 mg/kg total CRISPR Cas per dose administered as, for example, a bolus intravenous infusion may be contemplated.

In yet another embodiment, a SNALP may comprise synthetic cholesterol (Sigma-Aldrich), 1,2-distearoyl-sn-glycero-3-phosphocholine (DSPC; Avanti Polar Lipids Inc.), PEG-cDMA, and 1,2-dilinoleyloxy-3-(N;N-dimethyl)aminopropane (DLinDMA) (see, e.g., Judge, J. Clin. Invest. 119:661-673 (2009)). Formulations used for in vivo studies may comprise a final lipid/RNA mass ratio of about 9:1.

The safety profile of RNAi nanomedicines has been reviewed by Barros and Gollob of Alnylam Pharmaceuticals (see, e.g., Advanced Drug Delivery Reviews 64 (2012) 1730-1737). The stable nucleic acid lipid particle (SNALP) is comprised of four different lipids an ionizable lipid (DLinDMA) that is cationic at low pH, a neutral helper lipid, cholesterol, and a diffusible polyethylene glycol (PEG)-lipid. The particle is approximately 80 nm in diameter and is charge-neutral at physiologic pH. During formulation, the ionizable lipid serves to condense lipid with the anionic RNA during particle formation. When positively charged under increasingly acidic endosomal conditions, the ionizable lipid also mediates the fusion of SNALP with the endosomal membrane enabling release of RNA into the cytoplasm. The PEG-lipid stabilizes the particle and reduces aggregation during formulation, and subsequently provides a neutral hydrophilic exterior that improves pharmacokinetic properties.

To date, two clinical programs have been initiated using SNALP formulations with RNA. Tekmira Pharmaceuticals recently completed a phase I single-dose study of SNALP-ApoB in adult volunteers with elevated LDL cholesterol. ApoB is predominantly expressed in the liver and jejunum and is essential for the assembly and secretion of VLDL and LDL. Seventeen subjects received a single dose of SNALP-ApoB (dose escalation across 7 dose levels). There was no evidence of liver toxicity (anticipated as the potential dose-limiting toxicity based on preclinical studies). One (of two) subjects at the highest dose experienced flu-like symptoms consistent with immune system stimulation, and the decision was made to conclude the trial.

Alnylam Pharmaceuticals has similarly advanced ALN-TTR01, which employs the SNALP technology described above and targets hepatocyte production of both mutant and wild-type TTR to treat TTR amyloidosis (ATTR). Three ATTR syndromes have been described: familial amyloidotic polyneuropathy (FAP) and familial amyloidotic cardiomyopathy (FAC) both caused by autosomal dominant mutations in TTR; and senile systemic amyloidosis (SSA) cause by wildtype TTR. A placebo-controlled, single dose-escalation phase I trial of ALN-TTR01 was recently completed in patients with ATTR. ALN-TTR01 was administered as a 15-minute IV infusion to 31 patients (23 with study drug and 8 with placebo) within a dose range of 0.01 to 1.0 mg/kg (based on siRNA). Treatment was well tolerated with no significant increases in liver function tests. Infusion-related reactions were noted in 3 of 23 patients at ≥0.4 mg/kg; all responded to slowing of the infusion rate and all continued on study. Minimal and transient elevations of serum cytokines IL-6, IP-10 and IL-1ra were noted in two patients at the highest dose of 1 mg/kg (as anticipated from preclinical and NHP studies). Lowering of serum TTR, the expected pharmacodynamics effect of ALN-TTR01, was observed at 1 mg/kg.

In yet another embodiment, a SNALP may be made by solubilizing a cationic lipid, DSPC, cholesterol and PEG-lipid e.g., in ethanol, e.g., at a molar ratio of 40:10:40:10, respectively (see, Semple et al., Nature Biotechnology, Volume 28 Number 2 Feb. 2010, pp. 172-177). The lipid mixture was added to an aqueous buffer (50 mM citrate, pH 4) with mixing to a final ethanol and lipid concentration of 30% (vol/vol) and 6.1 mg/ml, respectively, and allowed to equilibrate at 22° C. for 2 min before extrusion. The hydrated lipids were extruded through two stacked 80 nm pore-sized filters (Nuclepore) at 22° C. using a Lipex Extruder (Northern Lipids) until a vesicle diameter of 70-90 nm, as determined by dynamic light scattering analysis, was obtained. This generally required 1-3 passes. The siRNA (solubilized in a 50 mM citrate, pH 4 aqueous solution containing 30% ethanol) was added to the pre-equilibrated (35° C.) vesicles at a rate of ~5 ml/min with mixing. After a final target siRNA/lipid ratio of 0.06 (wt/wt) was reached, the mixture was incubated for a further 30 min at 35° C. to allow vesicle reorganization and encapsulation of the siRNA. The ethanol was then removed and the external buffer replaced with PBS (155 mM NaCl, 3 mM Na2HPO4, 1 mM KH2PO4, pH 7.5) by either dialysis or tangential flow diafiltration. siRNA were encapsulated in SNALP using a controlled step-wise dilution method process. The lipid constituents of KC2-SNALP were DLin-KC2-DMA (cationic lipid), dipalmitoylphosphatidylcholine (DPPC; Avanti Polar Lipids), synthetic cholesterol (Sigma) and PEG-C-DMA used at a molar ratio of 57.1:7.1:34.3:1.4. Upon formation of the loaded particles, SNALP were dialyzed against PBS and filter sterilized through a 0.2 m filter before use. Mean particle sizes were 75-85 nm and 90-95% of the siRNA was encapsulated within the lipid particles. The final siRNA/lipid ratio in formulations used for in vivo testing was ~0.15 (wt/wt). LNP-siRNA systems containing Factor VII siRNA were diluted to the appropriate concentrations in sterile PBS immediately before use and the formulations were administered intravenously through the lateral tail vein in a total volume of 10 ml/kg. This method and these delivery systems may be extrapolated to the AD-functionalized CRISPR Cas system of the present invention.

Other Lipids

Other cationic lipids, such as amino lipid 2,2-dilinoleyl-4-dimethylaminoethyl-[1,3]-dioxolane (DLin-KC2-DMA) may be utilized to encapsulate CRISPR Cas or components thereof or nucleic acid molecule(s) coding therefor e.g., similar to SiRNA (see, e.g., Jayaraman, Angew. Chem. Int. Ed. 2012, 51, 8529-8533), and hence may be employed in the practice of the invention. A preformed vesicle with the following lipid composition may be contemplated: amino lipid, distearoylphosphatidylcholine (DSPC), cholesterol and (R)-2,3-bis(octadecyloxy) propyl-1-(methoxy poly(ethylene glycol)2000)propylcarbamate (PEG-lipid) in the molar ratio 40/10/40/10, respectively, and a FVII siRNA/total lipid ratio of approximately 0.05 (w/w). To ensure a narrow particle size distribution in the range of 70-90 nm and a low polydispersity index of 0.11+0.04 (n=56), the particles may be extruded up to three times through 80 nm membranes prior to adding the guide RNA. Particles containing the highly potent amino lipid 16 may be used, in which the molar ratio of the four lipid components 16, DSPC, cholesterol and PEG-lipid (50/10/38.5/1.5) which may be further optimized to enhance in vivo activity.

Michael S D Kormann et al. ("Expression of therapeutic proteins after delivery of chemically modified mRNA in mice: Nature Biotechnology, Volume:29, Pages: 154-157 (2011)) describes the use of lipid envelopes to deliver RNA. Use of lipid envelopes is also preferred in the present invention.

In another embodiment, lipids may be formulated with the AD-functionalized CRISPR Cas system of the present invention or component(s) thereof or nucleic acid molecule(s) coding therefor to form lipid nanoparticles (LNPs). Lipids include, but are not limited to, DLin-KC2-DMA4, C12-200 and co-lipids distearoylphosphatidyl choline, cholesterol, and PEG-DMG may be formulated with CRISPR Cas instead of siRNA (see, e.g., Novobrantseva, Molecular Therapy-Nucleic Acids (2012) 1, e4; doi:10.1038/mtna.2011.3) using a spontaneous vesicle formation procedure. The component molar ratio may be about 50/10/38.5/1.5 (DLin-KC2-DMA or C12-200/disteroylphosphatidyl choline/cholesterol/PEG-DMG). The final lipid:siRNA weight ratio may be ~12:1 and 9:1 in the case of DLin-KC2-DMA and C12-200 lipid nanoparticles (LNPs), respectively. The formulations may have mean particle diameters of ~80 nm with >90% entrapment efficiency. A 3 mg/kg dose may be contemplated.

Tekmira has a portfolio of approximately 95 patent families, in the U.S. and abroad, that are directed to various aspects of LNPs and LNP formulations (see, e.g., U.S. Pat. Nos. 7,982,027; 7,799,565; 8,058,069; 8,283,333; 7,901,708; 7,745,651; 7,803,397; 8,101,741; 8,188,263; 7,915,399; 8,236,943 and 7,838,658 and European Pat. Nos 1766035; 1519714; 1781593 and 1664316), all of which may be used and/or adapted to the present invention.

The AD-functionalized CRISPR Cas system or components thereof or nucleic acid molecule(s) coding therefor may be delivered encapsulated in PLGA Microspheres such as that further described in US published applications 20130252281 and 20130245107 and 20130244279 (assigned to Moderna Therapeutics) which relate to aspects of formulation of compositions comprising modified nucleic acid molecules which may encode a protein, a protein precursor, or a partially or fully processed form of the protein or a protein precursor. The formulation may have a molar ratio 50:10:38.5:1.5-3.0 (cationic lipid:fusogenic lipid:cholesterol:PEG lipid). The PEG lipid may be selected from, but is not limited to PEG-c-DOMG, PEG-DMG. The fusogenic lipid may be DSPC. See also, Schrum et al., Delivery and Formulation of Engineered Nucleic Acids, US published application 20120251618.

Nanomerics' technology addresses bioavailability challenges for a broad range of therapeutics, including low molecular weight hydrophobic drugs, peptides, and nucleic acid based therapeutics (plasmid, siRNA, miRNA). Specific administration routes for which the technology has demonstrated clear advantages include the oral route, transport across the blood-brain-barrier, delivery to solid tumours, as well as to the eye. See, e.g., Mazza et al., 2013, ACS Nano. 2013 Feb. 26; 7(2):1016-26; Uchegbu and Siew, 2013, J Pharm Sci. 102(2):305-10 and Lalatsa et al., 2012, J Control Release. 2012 Jul. 20; 161(2):523-36.

US Patent Publication No. 20050019923 describes cationic dendrimers for delivering bioactive molecules, such as polynucleotide molecules, peptides and polypeptides and/or pharmaceutical agents, to a mammalian body. The dendrimers are suitable for targeting the delivery of the bioactive molecules to, for example, the liver, spleen, lung, kidney or heart (or even the brain). Dendrimers are synthetic 3-dimensional macromolecules that are prepared in a step-wise fashion from simple branched monomer units, the nature and functionality of which can be easily controlled and varied. Dendrimers are synthesised from the repeated addition of building blocks to a multifunctional core (divergent approach to synthesis), or towards a multifunctional core (convergent approach to synthesis) and each addition of a 3-dimensional shell of building blocks leads to the formation of a higher generation of the dendrimers. Polypropylenimine dendrimers start from a diaminobutane core to which is added twice the number of amino groups by a double Michael addition of acrylonitrile to the primary amines followed by the hydrogenation of the nitriles. This results in a doubling of the amino groups. Polypropylenimine dendrimers contain 100% protonable nitrogens and up to 64 terminal amino groups (generation 5, DAB 64). Protonable groups are usually amine groups which are able to accept protons at neutral pH. The use of dendrimers as gene delivery agents has largely focused on the use of the polyamidoamine. and phosphorous containing compounds with a mixture of amine/amide or N—P(O2)S as the conjugating units respectively with no work being reported on the use of the lower generation polypropylenimine dendrimers for gene delivery. Polypropylenimine dendrimers have also been studied as pH sensitive controlled release systems for drug delivery and for their encapsulation of guest molecules when chemically modified by peripheral amino acid groups. The cytotoxicity and interaction of polypropylenimine dendrimers with DNA as well as the transfection efficacy of DAB 64 has also been studied.

US Patent Publication No. 20050019923 is based upon the observation that, contrary to earlier reports, cationic dendrimers, such as polypropylenimine dendrimers, display suitable properties, such as specific targeting and low toxicity, for use in the targeted delivery of bioactive molecules, such as genetic material. In addition, derivatives of the cationic dendrimer also display suitable properties for the targeted delivery of bioactive molecules. See also, Bioactive Polymers, US published application 20080267903, which discloses "Various polymers, including cationic polyamine polymers and dendrimeric polymers, are shown to possess anti-proliferative activity, and may therefore be useful for treatment of disorders characterised by undesirable cellular proliferation such as neoplasms and tumours, inflammatory disorders (including autoimmune disorders), psoriasis and atherosclerosis. The polymers may be used alone as active agents, or as delivery vehicles for other therapeutic agents, such as drug molecules or nucleic acids for gene therapy. In such cases, the polymers' own intrinsic anti-tumour activity may complement the activity of the agent to be delivered." The disclosures of these patent publications may be employed in conjunction with herein teachings for delivery of AD-functionalized CRISPR Cas system(s) or component(s) thereof or nucleic acid molecule(s) coding therefor.

Supercharged Proteins

Supercharged proteins are a class of engineered or naturally occurring proteins with unusually high positive or negative net theoretical charge and may be employed in delivery of AD-functionalized CRISPR Cas system(s) or component(s) thereof or nucleic acid molecule(s) coding therefor. Both supernegatively and superpositively charged proteins exhibit a remarkable ability to withstand thermally or chemically induced aggregation. Superpositively charged proteins are also able to penetrate mammalian cells. Associating cargo with these proteins, such as plasmid DNA, RNA, or other proteins, can enable the functional delivery of these macromolecules into mammalian cells both in vitro and in vivo. The creation and characterization of supercharged proteins has been reported in 2007 (Lawrence et al., 2007, Journal of the American Chemical Society 129, 10110-10112).

The nonviral delivery of RNA and plasmid DNA into mammalian cells are valuable both for research and therapeutic applications (Akinc et al., 2010, Nat. Biotech. 26, 561-569). Purified +36 GFP protein (or other superpositively charged protein) is mixed with RNAs in the appropriate serum-free media and allowed to complex prior addition to cells. Inclusion of serum at this stage inhibits formation of the supercharged protein-RNA complexes and reduces the effectiveness of the treatment. The following protocol has been found to be effective for a variety of cell lines (McNaughton et al., 2009, Proc. Natl. Acad. Sci. USA 106, 6111-6116) (However, pilot experiments varying the dose of protein and RNA should be performed to optimize the procedure for specific cell lines): (1) One day before treatment, plate 1×105 cells per well in a 48-well plate. (2) On the day of treatment, dilute purified +36 GFP protein in serum free media to a final concentration 200 nM. Add RNA to a final concentration of 50 nM. Vortex to mix and incubate at room temperature for 10 min. (3) During incubation, aspirate media from cells and wash once with PBS. (4) Following incubation of +36 GFP and RNA, add the protein-RNA complexes to cells. (5) Incubate cells with complexes at 37° C. for 4 h. (6) Following incubation, aspirate the media and wash three times with 20 U/mL heparin PBS. Incubate cells with serum-containing media for a further 48 h or longer depending upon the assay for activity. (7) Analyze cells by immunoblot, qPCR, phenotypic assay, or other appropriate method.

It has been further found +36 GFP to be an effective plasmid delivery reagent in a range of cells. As plasmid DNA is a larger cargo than siRNA, proportionately more +36 GFP protein is required to effectively complex plasmids. For effective plasmid delivery Applicants have developed a variant of +36 GFP bearing a C-terminal HA2 peptide tag, a known endosome-disrupting peptide derived from the influenza virus hemagglutinin protein. The following protocol has been effective in a variety of cells, but as above it is advised that plasmid DNA and supercharged protein doses be optimized for specific cell lines and delivery applications: (1) One day before treatment, plate 1×105 per well in a 48-well plate. (2) On the day of treatment, dilute purified b36 GFP protein in serum free media to a final concentration 2 mM. Add 1 mg of plasmid DNA. Vortex to mix and incubate at room temperature for 10 min. (3) During incubation, aspirate media from cells and wash once with PBS. (4) Following incubation of b36 GFP and plasmid DNA, gently add the protein-DNA complexes to cells. (5) Incubate cells with complexes at 37 C for 4 h. (6) Following incubation, aspirate the media and wash with PBS. Incubate cells in serum-containing media and incubate for a further 24-48 h. (7) Analyze plasmid delivery (e.g., by plasmid-driven gene expression) as appropriate.

See also, e.g., McNaughton et al., Proc. Natl. Acad. Sci. USA 106, 6111-6116 (2009); Cronican et al., ACS Chemical Biology 5, 747-752 (2010); Cronican et al., Chemistry & Biology 18, 833-838 (2011); Thompson et al., Methods in Enzymology 503, 293-319 (2012); Thompson, D. B., et al., Chemistry & Biology 19 (7), 831-843 (2012). The methods of the super charged proteins may be used and/or adapted for delivery of the AD-functionalized CRISPR Cas system of the present invention. These systems in conjunction with herein teaching can be employed in the delivery of AD-functionalized CRISPR Cas system(s) or component(s) thereof or nucleic acid molecule(s) coding therefor.

Cell Penetrating Peptides (CPPs)

In yet another embodiment, cell penetrating peptides (CPPs) are contemplated for the delivery of the AD-functionalized CRISPR Cas system. CPPs are short peptides that facilitate cellular uptake of various molecular cargo (from nanosize particles to small chemical molecules and large fragments of DNA). The term "cargo" as used herein includes but is not limited to the group consisting of therapeutic agents, diagnostic probes, peptides, nucleic acids, antisense oligonucleotides, plasmids, proteins, particles, including nanoparticles, liposomes, chromophores, small molecules and radioactive materials. In aspects of the invention, the cargo may also comprise any component of the AD-functionalized CRISPR Cas system or the entire AD-functionalized functional CRISPR Cas system. Aspects of the present invention further provide methods for delivering a desired cargo into a subject comprising: (a) preparing a complex comprising the cell penetrating peptide of the present invention and a desired cargo, and (b) orally, intraarticularly, intraperitoneally, intrathecally, intraarterially, intranasally, intraparenchymally, subcutaneously, intramuscularly, intravenously, dermally, intrarectally, or topically administering the complex to a subject. The cargo is associated with the peptides either through chemical linkage via covalent bonds or through non-covalent interactions.

The function of the CPPs are to deliver the cargo into cells, a process that commonly occurs through endocytosis with the cargo delivered to the endosomes of living mammalian cells. Cell-penetrating peptides are of different sizes, amino acid sequences, and charges but all CPPs have one distinct characteristic, which is the ability to translocate the plasma membrane and facilitate the delivery of various molecular cargoes to the cytoplasm or an organelle. CPP translocation may be classified into three main entry mechanisms: direct penetration in the membrane, endocytosis-mediated entry, and translocation through the formation of a transitory structure. CPPs have found numerous applications in medicine as drug delivery agents in the treatment of different diseases including cancer and virus inhibitors, as well as contrast agents for cell labeling. Examples of the latter include acting as a carrier for GFP, MRI contrast agents, or quantum dots. CPPs hold great potential as in vitro and in vivo delivery vectors for use in research and medicine. CPPs typically have an amino acid composition that either contains a high relative abundance of positively charged amino acids such as lysine or arginine or has sequences that contain an alternating pattern of polar/charged amino acids and non-polar, hydrophobic amino acids. These two types of structures are referred to as polycationic or amphipathic, respectively. A third class of CPPs are the hydrophobic peptides, containing only apolar residues, with low net charge or have hydrophobic amino acid groups that are crucial for cellular uptake. One of the initial CPPs discovered was the trans-activating transcriptional activator (Tat) from Human Immunodeficiency Virus 1 (HIV-1) which was found to be efficiently taken up from the surrounding media by numerous cell types in culture. Since then, the number of known CPPs has expanded considerably and small molecule synthetic analogues with more effective protein transduction properties have been generated. CPPs include but are not limited to Penetratin, Tat (48-60), Transportan, and (R-AhX-R4) (Ahx=aminohexanoyl).

U.S. Pat. No. 8,372,951, provides a CPP derived from eosinophil cationic protein (ECP) which exhibits highly cell-penetrating efficiency and low toxicity. Aspects of delivering the CPP with its cargo into a vertebrate subject are also provided. Further aspects of CPPs and their delivery are described in U.S. Pat. Nos. 8,575,305; 8,614,194 and 8,044,019. CPPs can be used to deliver the AD-functionalized CRISPR-Cas system or components thereof. That CPPs can be employed to deliver the AD-functionalized CRISPR-Cas system or components thereof is also provided in the manuscript "Gene disruption by cell-penetrating peptide-mediated delivery of Cas9 protein and guide RNA", by Suresh Ramakrishna, Abu-Bonsrah Kwaku Dad, Jagadish Beloor, et al. Genome Res. 2014 Apr. 2, incorporated by reference in its entirety, wherein it is demonstrated that treatment with CPP-conjugated recombinant Cas9 protein and CPP-complexed guide RNAs lead to endogenous gene disruptions in human cell lines. In the paper the Cas9 protein was conjugated to CPP via a thioether bond, whereas the guide RNA was complexed with CPP, forming condensed, positively charged particles. It was shown that simultaneous and sequential treatment of human cells, including embryonic stem cells, dermal fibroblasts, HEK293T cells, HeLa cells, and embryonic carcinoma cells, with the modified Cas9 and guide RNA led to efficient gene disruptions with reduced off-target mutations relative to plasmid transfections.

Aerosol Delivery

Subjects treated for a lung disease may for example receive pharmaceutically effective amount of aerosolized AAV vector system per lung endobronchially delivered while spontaneously breathing. As such, aerosolized delivery is preferred for AAV delivery in general. An adenovirus or an AAV particle may be used for delivery. Suitable gene constructs, each operably linked to one or more regulatory sequences, may be cloned into the delivery vector.

Packaging and Promoters

The promoter used to drive CRISPR-Cas protein and adenosine deaminase coding nucleic acid molecule expression can include AAV ITR, which can serve as a promoter. This is advantageous for eliminating the need for an additional promoter element (which can take up space in the vector). The additional space freed up can be used to drive the expression of additional elements (gRNA, etc.). Also, ITR activity is relatively weaker, so can be used to reduce potential toxicity due to over expression of Cas13.

For ubiquitous expression, promoters that can be used include: CMV, CAG, CBh, PGK, SV40, Ferritin heavy or light chains, etc. For brain or other CNS expression, Synapsin I can be used for all neurons, CaMKIIalpha can be used for excitatory neurons, GAD67 or GAD65 or VGAT can be used for GABAergic neurons. For liver expression, Albumin promoter can be used. For lung expression, SP-B can be used. For endothelial cells, ICAM can be used. For hematopoietic cells, IFNbeta or CD45 can be used. For Osteoblasts, the OG-2 can be used.

The promoter used to drive guide RNA can include Pol III promoters such as U6 or H1, as well as use of Pol II promoter and intronic cassettes to express guide RNA.

Adeno Associated Virus (AAV)

The CRISPR-Cas protein, adenosine deaminase, and one or more guide RNA can be delivered using adeno associated virus (AAV), lentivirus, adenovirus or other plasmid or viral vector types, in particular, using formulations and doses from, for example, U.S. Pat. No. 8,454,972 (formulations, doses for adenovirus), U.S. Pat. No. 8,404,658 (formulations, doses for AAV) and U.S. Pat. No. 5,846,946 (formulations, doses for DNA plasmids) and from clinical trials and publications regarding the clinical trials involving lentivirus, AAV and adenovirus. For examples, for AAV, the route of administration, formulation and dose can be as in U.S. Pat. No. 8,454,972 and as in clinical trials involving AAV. For Adenovirus, the route of administration, formulation and dose can be as in U.S. Pat. No. 8,404,658 and as in clinical trials involving adenovirus. For plasmid delivery, the route of administration, formulation and dose can be as in U.S. Pat. No. 5,846,946 and as in clinical studies involving plasmids. Doses may be based on or extrapolated to an average 70 kg individual (e.g. a male adult human), and can be adjusted for patients, subjects, mammals of different weight and species. Frequency of administration is within the ambit of the medical or veterinary practitioner (e.g., physician, veterinarian), depending on usual factors including the age, sex, general health, other conditions of the patient or subject and the particular condition or symptoms being addressed. The viral vectors can be injected into the tissue of interest. For cell-type specific genome modification, the expression of Cas13 and adenosine deaminase can be driven by a cell-type specific promoter. For example, liver-specific expression might use the Albumin promoter and neuron-specific expression (e.g. for targeting CNS disorders) might use the Synapsin I promoter.

In terms of in vivo delivery, AAV is advantageous over other viral vectors for a couple of reasons: low toxicity (this may be due to the purification method not requiring ultra centrifugation of cell particles that can activate the immune response); and low probability of causing insertional mutagenesis because it doesn't integrate into the host genome.

AAV has a packaging limit of 4.5 or 4.75 Kb. This means that Cas13 as well as a promoter and transcription terminator have to be all fit into the same viral vector. Constructs larger than 4.5 or 4.75 Kb will lead to significantly reduced virus production. SpCas9 is quite large, the gene itself is over 4.1 Kb, which makes it difficult for packing into AAV. Therefore embodiments of the invention include utilizing homologs of Cas13 that are shorter.

As to AAV, the AAV can be AAV1, AAV2, AAV5 or any combination thereof. One can select the AAV of the AAV with regard to the cells to be targeted; e.g., one can select AAV serotypes 1, 2, 5 or a hybrid capsid AAV1, AAV2, AAV5 or any combination thereof for targeting brain or neuronal cells; and one can select AAV4 for targeting cardiac tissue. AAV8 is useful for delivery to the liver. The herein promoters and vectors are preferred individually. A tabulation of certain AAV serotypes as to these cells (see Grimm, D. et al, J. Virol. 82: 5887-5911 (2008)) is as follows:

| Cell Line | AAV-1 | AAV-2 | AAV-3 | AAV-4 | AAV-5 | AAV-6 | AAV-8 | AAV-9 |
|---|---|---|---|---|---|---|---|---|
| Huh-7 | 13 | 100 | 2.5 | 0.0 | 0.1 | 10 | 0.7 | 0.0 |
| HEK293 | 25 | 100 | 2.5 | 0.1 | 0.1 | 5 | 0.7 | 0.1 |

-continued

| Cell Line | AAV-1 | AAV-2 | AAV-3 | AAV-4 | AAV-5 | AAV-6 | AAV-8 | AAV-9 |
|---|---|---|---|---|---|---|---|---|
| HeLa | 3 | 100 | 2.0 | 0.1 | 6.7 | 1 | 0.2 | 0.1 |
| HepG2 | 3 | 100 | 16.7 | 0.3 | 1.7 | 5 | 0.3 | ND |
| Hep1A | 20 | 100 | 0.2 | 1.0 | 0.1 | 1 | 0.2 | 0.0 |
| 911 | 17 | 100 | 11 | 0.2 | 0.1 | 17 | 0.1 | ND |
| CHO | 100 | 100 | 14 | 1.4 | 333 | 50 | 10 | 1.0 |
| COS | 33 | 100 | 33 | 3.3 | 5.0 | 14 | 2.0 | 0.5 |
| MeWo | 10 | 100 | 20 | 0.3 | 6.7 | 10 | 1.0 | 0.2 |
| NIH3T3 | 10 | 100 | 2.9 | 2.9 | 0.3 | 10 | 0.3 | ND |
| A549 | 14 | 100 | 20 | ND | 0.5 | 10 | 0.5 | 0.1 |
| HT1180 | 20 | 100 | 10 | 0.1 | 0.3 | 33 | 0.5 | 0.1 |
| Monocytes | 1111 | 100 | ND | ND | 125 | 1429 | ND | ND |
| Immature DC | 2500 | 100 | ND | ND | 222 | 2857 | ND | ND |
| Mature DC | 2222 | 100 | ND | ND | 333 | 3333 | ND | ND |

Lentiviruses

Lentiviruses are complex retroviruses that have the ability to infect and express their genes in both mitotic and post-mitotic cells. The most commonly known lentivirus is the human immunodeficiency virus (HIV), which uses the envelope glycoproteins of other viruses to target a broad range of cell types.

Lentiviruses may be prepared as follows. After cloning pCasES10 (which contains a lentiviral transfer plasmid backbone), HEK293FT at low passage (p=5) were seeded in a T-75 flask to 50% confluence the day before transfection in DMEM with 10% fetal bovine serum and without antibiotics. After 20 hours, media was changed to OptiMEM (serum-free) media and transfection was done 4 hours later. Cells were transfected with 10 µg of lentiviral transfer plasmid (pCasES10) and the following packaging plasmids: 5 µg of pMD2.G (VSV-g pseudotype), and 7.5 ug of psPAX2 (gag/pol/rev/tat). Transfection was done in 4 mL OptiMEM with a cationic lipid delivery agent (50 uL Lipofectamine 2000 and 100 ul Plus reagent). After 6 hours, the media was changed to antibiotic-free DMEM with 10% fetal bovine serum. These methods use serum during cell culture, but serum-free methods are preferred.

Lentivirus may be purified as follows. Viral supernatants were harvested after 48 hours. Supernatants were first cleared of debris and filtered through a 0.45 um low protein binding (PVDF) filter. They were then spun in a ultracentrifuge for 2 hours at 24,000 rpm. Viral pellets were resuspended in 50 ul of DMEM overnight at 4 C. They were then aliquoted and immediately frozen at −80° C.

In another embodiment, minimal non-primate lentiviral vectors based on the equine infectious anemia virus (EIAV) are also contemplated, especially for ocular gene therapy (see, e.g., Balagaan, J Gene Med 2006; 8: 275-285). In another embodiment, RetinoStat®, an equine infectious anemia virus-based lentiviral gene therapy vector that expresses angiostatic proteins endostatin and angiostatin that is delivered via a subretinal injection for the treatment of the web form of age-related macular degeneration is also contemplated (see, e.g., Binley et al., HUMAN GENE THERAPY 23:980-991 (September 2012)) and this vector may be modified for the AD-functionalized CRISPR-Cas system of the present invention.

In another embodiment, self-inactivating lentiviral vectors with an siRNA targeting a common exon shared by HIV tat/rev, a nucleolar-localizing TAR decoy, and an anti-CCR5-specific hammerhead ribozyme (see, e.g., DiGiusto et al. (2010) Sci Transl Med 2:36ra43) may be used/and or adapted to the AD-functionalized CRISPR-Cas system of the present invention. A minimum of 2.5×106 CD34+ cells per kilogram patient weight may be collected and prestimulated for 16 to 20 hours in X-VIVO 15 medium (Lonza) containing 2 µmol/L-glutamine, stem cell factor (100 ng/ml), Flt-3 ligand (Flt-3L) (100 ng/ml), and thrombopoietin (10 ng/ml) (CellGenix) at a density of 2×106 cells/ml. Prestimulated cells may be transduced with lentiviral at a multiplicity of infection of 5 for 16 to 24 hours in 75-cm2 tissue culture flasks coated with fibronectin (25 mg/cm2) (RetroNectin, Takara Bio Inc.).

Lentiviral vectors have been disclosed as in the treatment for Parkinson's Disease, see, e.g., US Patent Publication No. 20120295960 and U.S. Pat. Nos. 7,303,910 and 7,351,585. Lentiviral vectors have also been disclosed for the treatment of ocular diseases, see e.g., US Patent Publication Nos. 20060281180, 20090007284, US20110117189; US20090017543; US20070054961, US20100317109. Lentiviral vectors have also been disclosed for delivery to the brain, see, e.g., US Patent Publication Nos. US20110293571; US20110293571, US20040013648, US20070025970, US20090111106 and U.S. Pat. No. 7,259,015.

Application in Non-Animal Organisms

The AD-functionalized CRISPR system(s) (e.g., single or multiplexed) can be used in conjunction with recent advances in crop genomics. The systems described herein can be used to perform efficient and cost effective plant gene or genome interrogation or editing or manipulation—for instance, for rapid investigation and/or selection and/or interrogations and/or comparison and/or manipulations and/or transformation of plant genes or genomes; e.g., to create, identify, develop, optimize, or confer trait(s) or characteristic(s) to plant(s) or to transform a plant genome. There can accordingly be improved production of plants, new plants with new combinations of traits or characteristics or new plants with enhanced traits. The AD-functionalized CRISPR system can be used with regard to plants in Site-Directed Integration (SDI) or Gene Editing (GE) or any Near Reverse Breeding (NRB) or Reverse Breeding (RB) techniques. Aspects of utilizing the herein described Cas13 effector protein systems may be analogous to the use of the CRISPR-Cas (e.g. CRISPR-Cas9) system in plants, and mention is made of the University of Arizona website "CRISPR-PLANT" (genome.arizona.edu/crispr/) (supported by Penn State and AGI). Embodiments of the invention can be used in genome editing in plants or where RNAi or similar genome editing techniques have been used previously; see, e.g., Nekrasov, "Plant genome editing made easy: targeted mutagenesis in model and crop plants using the CRISPR- Cas system," Plant Methods 2013, 9:39 (doi:10.1186/1746-4811-9-39); Brooks, "Efficient gene editing in tomato in the first generation using the CRISPR-Cas9 system," Plant Physiology September 2014 pp 114.247577; Shan, "Targeted genome modification of crop plants using a CRISPR-Cas system," Nature Biotechnology 31, 686-688 (2013); Feng, "Efficient genome editing in plants using a CRISPR-Cas system," Cell Research (2013) 23:1229-1232. doi: 10.1038/cr.2013.114; published online 20 Aug. 2013; Xie, "RNA-guided genome editing in plants using a CRISPR-Cas system," Mol Plant. 2013 November; 6(6):1975-83. doi: 10.1093/mp/sst119. Epub 2013 Aug. 17; Xu, "Gene targeting using the *Agrobacterium tumefaciens*-mediated CRISPR-Cas system in rice," Rice 2014, 7:5 (2014), Zhou et al., "Exploiting SNPs for biallelic CRISPR mutations in the outcrossing woody perennial *Populus* reveals 4-coumarate: CoA ligase specificity and Redundancy," New Phytologist (2015) (Forum) 1-4 (available online only at www.newphytologist.com); Caliando et al, "Targeted DNA degradation using a CRISPR device stably carried in the host genome, NATURE COMMUNICATIONS 6:6989, DOI: 10.1038/ncomms7989, www.nature.com/naturecommunications DOI: 10.1038/ncomms7989; U.S. Pat. No. 6,603,061 —*Agrobacterium*-Mediated Plant Transformation Method; U.S. Pat. No. 7,868,149—Plant Genome Sequences and Uses Thereof and US 2009/0100536—Transgenic Plants with Enhanced Agronomic Traits, all the contents and disclosure of each of which are herein incorporated by reference in their entirety. In the practice of the invention, the contents and disclosure of Morrell et al "Crop genomics: advances and applications," Nat Rev Genet. 2011 Dec. 29; 13(2):85-96; each of which is incorporated by reference herein including as to how herein embodiments may be used as to plants. Accordingly, reference herein to animal cells may also apply, mutatis mutandis, to plant cells unless otherwise apparent; and, the enzymes herein having reduced off-target effects and systems employing such enzymes can be used in plant applications, including those mentioned herein.

Application of AD-Functionalized CRISPR System to Plants and Yeast

In general, the term "plant" relates to any various photosynthetic, eukaryotic, unicellular or multicellular organism of the kingdom Plantae characteristically growing by cell division, containing chloroplasts, and having cell walls comprised of cellulose. The term plant encompasses monocotyledonous and dicotyledonous plants. Specifically, the plants are intended to comprise without limitation angiosperm and gymnosperm plants such as acacia, alfalfa, amaranth, apple, apricot, artichoke, ash tree, asparagus, avocado, banana, barley, beans, beet, birch, beech, blackberry, blueberry, broccoli, Brussel's sprouts, cabbage, canola, cantaloupe, carrot, cassava, cauliflower, cedar, a cereal, celery, chestnut, cherry, Chinese cabbage, citrus, clementine, clover, coffee, corn, cotton, cowpea, cucumber, cypress, eggplant, elm, endive, eucalyptus, fennel, figs, fir, geranium, grape, grapefruit, groundnuts, ground cherry, gum hemlock, hickory, kale, kiwifruit, kohlrabi, larch, lettuce, leek, lemon, lime, locust, pine, maidenhair, maize, mango, maple, melon, millet, mushroom, mustard, nuts, oak, oats, oil palm, okra, onion, orange, an ornamental plant or flower or tree, papaya, palm, parsley, parsnip, pea, peach, peanut, pear, peat, pepper, persimmon, pigeon pea, pine, pineapple, plantain, plum, pomegranate, potato, pumpkin, radicchio, radish, rapeseed, raspberry, rice, rye, sorghum, safflower, sallow, soybean, spinach, spruce, squash, strawberry, sugar beet, sugarcane, sunflower, sweet potato, sweet corn, tangerine, tea, tobacco, tomato, trees, triticale, turf grasses, turnips, vine, walnut, watercress, watermelon, wheat, yams, yew, and zucchini. The term plant also encompasses Algae, which are mainly photoautotrophs unified primarily by their lack of roots, leaves and other organs that characterize higher plants.

The methods for genome editing using the AD-functionalized CRISPR system as described herein can be used to confer desired traits on essentially any plant. A wide variety of plants and plant cell systems may be engineered for the desired physiological and agronomic characteristics described herein using the nucleic acid constructs of the present disclosure and the various transformation methods mentioned above. In preferred embodiments, target plants and plant cells for engineering include, but are not limited to, those monocotyledonous and dicotyledonous plants, such as crops including grain crops (e.g., wheat, maize, rice, millet, barley), fruit crops (e.g., tomato, apple, pear, strawberry, orange), forage crops (e.g., alfalfa), root vegetable crops (e.g., carrot, potato, sugar beets, yam), leafy vegetable crops (e.g., lettuce, spinach); flowering plants (e.g., petunia, rose, chrysanthemum), conifers and pine trees (e.g., pine fir, spruce); plants used in phytoremediation (e.g., heavy metal accumulating plants); oil crops (e.g., sunflower, rape seed) and plants used for experimental purposes (e.g., *Arabidopsis*). Thus, the methods and systems can be used over a broad range of plants, such as for example with dicotyledonous plants belonging to the orders Magnoliales, Illiciales, Laurales, Piperales, Aristochiales, Nymphaeales, Ranunculales, Papeverales, Sarraceniaceae, Trochodendrales, Hamamelidales, Eucomiales, Leitneriales, Myricales, Fagales, Casuarinales, Caryophyllales, Batales, Polygonales, Plumbaginales, Dilleniales, Theales, Malvales, Urticales, Lecythidales, Violales, Salicales, Capparales, Ericales, Diapensales, Ebenales, Primulales, Rosales, Fabales, Podostemales, Haloragales, Myrtales, Cornales, Proteales, San tales, Rafflesiales, Celastrales, Euphorbiales, Rhamnales, Sapindales, Juglandales, Geraniales, Polygalales, Umbellales, Gentianales, Polemoniales, Lamiales, Plantaginales, Scrophulariales, Campanulales, Rubiales, Dipsacales, and Asterales; the methods and CRISPR-Cas systems can be used with monocotyledonous plants such as those belonging to the orders Alismatales, Hydrocharitales, Najadales, Triuridales, Commelinales, Eriocaulales, Restionales, Poales, Juncales, Cyperales, Typhales, Bromeliales, Zingiberales, Arecales, Cyclanthales, Pandanales, Arales, Lilliales, and Orchid ales, or with plants belonging to Gymnospermae, e.g those belonging to the orders Pinales, Ginkgoales, Cycadales, Araucariales, Cupressales and Gnetales.

The AD-functionalized CRISPR systems and methods of use described herein can be used over a broad range of plant species, included in the non-limitative list of dicot, monocot or gymnosperm genera hereunder: *Atropa, Alseodaphne, Anacardium, Arachis, Beilschmiedia, Brassica, Carthamus, Cocculus, Croton, Cucumis, Citrus, Citrullus, Capsicum, Catharanthus, Cocos, Coffea, Cucurbita, Daucus, Duguetia, Eschscholzia, Ficus, Fragaria, Glaucium, Glycine, Gossypium, Helianthus, Hevea, Hyoscyamus, Lactuca, Landolphia, Linum, Litsea, Lycopersicon, Lupinus, Manihot, Majorana, Malus, Medicago, Nicotiana, Olea, Parthenium, Papaver, Persea, Phaseolus, Pistacia, Pisum, Pyrus, Prunus, Raphanus, Ricinus, Senecio, Sinomenium, Stephania, Sinapis, Solanum, Theobroma, Trifolium, Trigonella, Vicia, Vinca, Vilis,* and *Vigna*; and the genera *Allium, Andropogon, Eragrostis Asparagus, Avena, Cynodon, Elaeis, Festuca, Festulolium, Heterocallis, Hordeum, Lemna, Lolium, Musa, Oryza, Panicum, Pennisetum,*

*Phleum, Poa, Secale, Sorghum, Triticum, Zea, Abies, Cunninghamia, Ephedra, Picea, Pinus,* and *Pseudotsuga.*

The AD-functionalized CRISPR systems and methods of use can also be used over a broad range of "algae" or "algae cells"; including for example algae selected from several eukaryotic phyla, including the Rhodophyta (red algae), Chlorophyta (green algae), Phaeophyta (brown algae), Bacillariophyta (diatoms), Eustigmatophyta and dinoflagellates as well as the prokaryotic phylum Cyanobacteria (blue-green algae). The term "algae" includes for example algae selected from: *Amphora, Anabaena, Ankistrodesmus, Botryococcus, Chaetoceros, Chlamydomonas, Chlorella, Chlorococcum, Cyclotella, Cylindrotheca, Dunaliella, Emiliana, Euglena, Haematococcus, Isochrysis, Monochrysis, Monoraphidium, Nannochloris, Nannochloropsis, Navicula, Nephrochloris, Nephroselmis, Nitzschia, Nodularia, Nostoc, Ochromonas, Oocystis, Oscillatoria, Pavlova, Phaeodactylum, Platymonas, Pleurochrysis, Porphyra, Pseudoanabaena, Pyramimonas, Stichococcus, Synechococcus, Synechocystis, Tetraselmis, Thalassiosira,* and *Trichodesmium.*

A part of a plant, i.e., a "plant tissue" may be treated according to the methods of the present invention to produce an improved plant. Plant tissue also encompasses plant cells. The term "plant cell" as used herein refers to individual units of a living plant, either in an intact whole plant or in an isolated form grown in in vitro tissue cultures, on media or agar, in suspension in a growth media or buffer or as a part of higher organized unites, such as, for example, plant tissue, a plant organ, or a whole plant.

A "protoplast" refers to a plant cell that has had its protective cell wall completely or partially removed using, for example, mechanical or enzymatic means resulting in an intact biochemical competent unit of living plant that can reform their cell wall, proliferate and regenerate grow into a whole plant under proper growing conditions.

The term "transformation" broadly refers to the process by which a plant host is genetically modified by the introduction of DNA by means of Agrobacteria or one of a variety of chemical or physical methods. As used herein, the term "plant host" refers to plants, including any cells, tissues, organs, or progeny of the plants. Many suitable plant tissues or plant cells can be transformed and include, but are not limited to, protoplasts, somatic embryos, pollen, leaves, seedlings, stems, calli, stolons, microtubers, and shoots. A plant tissue also refers to any clone of such a plant, seed, progeny, propagule whether generated sexually or asexually, and descendants of any of these, such as cuttings or seed.

The term "transformed" as used herein, refers to a cell, tissue, organ, or organism into which a foreign DNA molecule, such as a construct, has been introduced. The introduced DNA molecule may be integrated into the genomic DNA of the recipient cell, tissue, organ, or organism such that the introduced DNA molecule is transmitted to the subsequent progeny. In these embodiments, the "transformed" or "transgenic" cell or plant may also include progeny of the cell or plant and progeny produced from a breeding program employing such a transformed plant as a parent in a cross and exhibiting an altered phenotype resulting from the presence of the introduced DNA molecule. Preferably, the transgenic plant is fertile and capable of transmitting the introduced DNA to progeny through sexual reproduction.

The term "progeny", such as the progeny of a transgenic plant, is one that is born of, begotten by, or derived from a plant or the transgenic plant. The introduced DNA molecule may also be transiently introduced into the recipient cell such that the introduced DNA molecule is not inherited by subsequent progeny and thus not considered "transgenic". Accordingly, as used herein, a "non-transgenic" plant or plant cell is a plant which does not contain a foreign DNA stably integrated into its genome.

The term "plant promoter" as used herein is a promoter capable of initiating transcription in plant cells, whether or not its origin is a plant cell. Exemplary suitable plant promoters include, but are not limited to, those that are obtained from plants, plant viruses, and bacteria such as *Agrobacterium* or *Rhizobium* which comprise genes expressed in plant cells.

As used herein, a "fungal cell" refers to any type of eukaryotic cell within the kingdom of fungi. Phyla within the kingdom of fungi include Ascomycota, Basidiomycota, Blastocladiomycota, Chytridiomycota, Glomeromycota, Microsporidia, and Neocallimastigomycota. Fungal cells may include yeasts, molds, and filamentous fungi. In some embodiments, the fungal cell is a yeast cell.

As used herein, the term "yeast cell" refers to any fungal cell within the phyla Ascomycota and Basidiomycota. Yeast cells may include budding yeast cells, fission yeast cells, and mold cells. Without being limited to these organisms, many types of yeast used in laboratory and industrial settings are part of the phylum Ascomycota. In some embodiments, the yeast cell is an *S. cerevisiae, Kluyveromyces marxianus,* or *Issatchenkia orientalis* cell. Other yeast cells may include without limitation *Candida* spp. (e.g., *Candida albicans*), *Yarrowia* spp. (e.g., *Yarrowia lipolytica*), *Pichia* spp. (e.g., *Pichia pastoris*), *Kluyveromyces* spp. (e.g., *Kluyveromyces lactis* and *Kluyveromyces marxianus*), *Neurospora* spp. (e.g., *Neurospora crassa*), *Fusarium* spp. (e.g., *Fusarium oxysporum*), and *Issatchenkia* spp. (e.g., *Issatchenkia orientalis,* a.k.a. *Pichia kudriavzevii* and *Candida acidothermophilum*). In some embodiments, the fungal cell is a filamentous fungal cell. As used herein, the term "filamentous fungal cell" refers to any type of fungal cell that grows in filaments, i.e., hyphae or mycelia. Examples of filamentous fungal cells may include without limitation *Aspergillus* spp. (e.g., *Aspergillus niger*), *Trichoderma* spp. (e.g., *Trichoderma reesei*), *Rhizopus* spp. (e.g., *Rhizopus oryzae*), and *Mortierella* spp. (e.g., *Mortierella isabellina*).

In some embodiments, the fungal cell is an industrial strain. As used herein, "industrial strain" refers to any strain of fungal cell used in or isolated from an industrial process, e.g., production of a product on a commercial or industrial scale. Industrial strain may refer to a fungal species that is typically used in an industrial process, or it may refer to an isolate of a fungal species that may be also used for non-industrial purposes (e.g., laboratory research). Examples of industrial processes may include fermentation (e.g., in production of food or beverage products), distillation, biofuel production, production of a compound, and production of a polypeptide. Examples of industrial strains may include, without limitation, JAY270 and ATCC4124.

In some embodiments, the fungal cell is a polyploid cell. As used herein, a "polyploid" cell may refer to any cell whose genome is present in more than one copy. A polyploid cell may refer to a type of cell that is naturally found in a polyploid state, or it may refer to a cell that has been induced to exist in a polyploid state (e.g., through specific regulation, alteration, inactivation, activation, or modification of meiosis, cytokinesis, or DNA replication). A polyploid cell may refer to a cell whose entire genome is polyploid, or it may refer to a cell that is polyploid in a particular genomic locus of interest. Without wishing to be bound to theory, it is thought that the abundance of guideRNA may more often be a rate-limiting component in genome engineering of polyploid cells than in haploid cells, and thus the methods using the AD-functionalized CRISPR system described herein may take advantage of using a certain fungal cell type.

In some embodiments, the fungal cell is a diploid cell. As used herein, a "diploid" cell may refer to any cell whose genome is present in two copies. A diploid cell may refer to a type of cell that is naturally found in a diploid state, or it may refer to a cell that has been induced to exist in a diploid state (e.g., through specific regulation, alteration, inactivation, activation, or modification of meiosis, cytokinesis, or DNA replication). For example, the *S. cerevisiae* strain S228C may be maintained in a haploid or diploid state. A diploid cell may refer to a cell whose entire genome is diploid, or it may refer to a cell that is diploid in a particular genomic locus of interest. In some embodiments, the fungal cell is a haploid cell. As used herein, a "haploid" cell may refer to any cell whose genome is present in one copy. A haploid cell may refer to a type of cell that is naturally found in a haploid state, or it may refer to a cell that has been induced to exist in a haploid state (e.g., through specific regulation, alteration, inactivation, activation, or modification of meiosis, cytokinesis, or DNA replication). For example, the *S. cerevisiae* strain S228C may be maintained in a haploid or diploid state. A haploid cell may refer to a cell whose entire genome is haploid, or it may refer to a cell that is haploid in a particular genomic locus of interest.

As used herein, a "yeast expression vector" refers to a nucleic acid that contains one or more sequences encoding an RNA and/or polypeptide and may further contain any desired elements that control the expression of the nucleic acid(s), as well as any elements that enable the replication and maintenance of the expression vector inside the yeast cell. Many suitable yeast expression vectors and features thereof are known in the art; for example, various vectors and techniques are illustrated in Yeast Protocols, 2nd edition, Xiao, W., ed. (Humana Press, New York, 2007) and Buckholz, R. G. and Gleeson, M. A. (1991) Biotechnology (NY) 9(11): 1067-72. Yeast vectors may contain, without limitation, a centromeric (CEN) sequence, an autonomous replication sequence (ARS), a promoter, such as an RNA Polymerase III promoter, operably linked to a sequence of gene of interest, a terminator such as an RNA polymerase III terminator, an origin of replication, and a marker gene (e.g., auxotrophic, antibiotic, or other selectable markers). Examples of expression vectors for use in yeast may include plasmids, yeast artificial chromosomes, 2 plasmids, yeast integrative plasmids, yeast replicative plasmids, shuttle vectors, and episomal plasmids.

Stable Integration of AD-Functionalized CRISPR System Components in the Genome of Plants and Plant Cells In particular embodiments, it is envisaged that the polynucleotides encoding the components of the AD-functionalized CRISPR system are introduced for stable integration into the genome of a plant cell. In these embodiments, the design of the transformation vector or the expression system can be adjusted depending on for when, where and under what conditions the guide RNA and/or fusion protein of adenosine deaminase and Cas13 are expressed.

In particular embodiments, it is envisaged to introduce the components of the AD-functionalized CRISPR system stably into the genomic DNA of a plant cell. Additionally or alternatively, it is envisaged to introduce the components of the AD-functionalized CRISPR system for stable integration into the DNA of a plant organelle such as, but not limited to a plastid, e mitochondrion or a chloroplast.

The expression system for stable integration into the genome of a plant cell may contain one or more of the following elements: a promoter element that can be used to express the RNA and/or fusion protein of adenosine deaminase and Cas13 in a plant cell; a 5' untranslated region to enhance expression; an intron element to further enhance expression in certain cells, such as monocot cells; a multiple-cloning site to provide convenient restriction sites for inserting the guide RNA and/or the fusion protein of adenosine deaminase and Cas13 encoding sequences and other desired elements; and a 3' untranslated region to provide for efficient termination of the expressed transcript.

The elements of the expression system may be on one or more expression constructs which are either circular such as a plasmid or transformation vector, or non-circular such as linear double stranded DNA.

In a particular embodiment, a AD-functionalized CRISPR expression system comprises at least: a nucleotide sequence encoding a guide RNA (gRNA) that hybridizes with a target sequence in a plant, and wherein the guide RNA comprises a guide sequence and a direct repeat sequence, and a nucleotide sequence encoding a fusion protein of adenosine deaminase and Cas13, wherein components (a) or (b) are located on the same or on different constructs, and whereby the different nucleotide sequences can be under control of the same or a different regulatory element operable in a plant cell.

DNA construct(s) containing the components of the AD-functionalized CRISPR system, and, where applicable, template sequence may be introduced into the genome of a plant, plant part, or plant cell by a variety of conventional techniques. The process generally comprises the steps of selecting a suitable host cell or host tissue, introducing the construct(s) into the host cell or host tissue, and regenerating plant cells or plants therefrom.

In particular embodiments, the DNA construct may be introduced into the plant cell using techniques such as but not limited to electroporation, microinjection, aerosol beam injection of plant cell protoplasts, or the DNA constructs can be introduced directly to plant tissue using biolistic methods, such as DNA particle bombardment (see also Fu et al., Transgenic Res. 2000 February; 9(1):11-9). The basis of particle bombardment is the acceleration of particles coated with gene/s of interest toward cells, resulting in the penetration of the protoplasm by the particles and typically stable integration into the genome. (see e.g. Klein et al, Nature (1987), Klein et ah, Bio/Technology (1992), Casas et ah, Proc. Natl. Acad. Sci. USA (1993).).

In particular embodiments, the DNA constructs containing components of the AD-functionalized CRISPR system may be introduced into the plant by *Agrobacterium*-mediated transformation. The DNA constructs may be combined with suitable T-DNA flanking regions and introduced into a conventional *Agrobacterium tumefaciens* host vector. The foreign DNA can be incorporated into the genome of plants by infecting the plants or by incubating plant protoplasts with *Agrobacterium* bacteria, containing one or more Ti (tumor-inducing) plasmids. (see e.g. Fraley et al., (1985), Rogers et al., (1987) and U.S. Pat. No. 5,563,055).

Plant Promoters

In order to ensure appropriate expression in a plant cell, the components of the AD-functionalized CRISPR system described herein are typically placed under control of a plant promoter, i.e. a promoter operable in plant cells. The use of different types of promoters is envisaged.

A constitutive plant promoter is a promoter that is able to express the open reading frame (ORF) that it controls in all or nearly all of the plant tissues during all or nearly all developmental stages of the plant (referred to as "constitutive expression"). One non-limiting example of a constitutive promoter is the cauliflower mosaic virus 35S promoter. "Regulated promoter" refers to promoters that direct gene expression not constitutively, but in a temporally- and/or spatially-regulated manner, and includes tissue-specific, tissue-preferred and inducible promoters. Different promoters may direct the expression of a gene in different tissues or cell types, or at different stages of development, or in response to different environmental conditions. In particular embodiments, one or more of the AD-functionalized CRISPR components are expressed under the control of a constitutive promoter, such as the cauliflower mosaic virus 35S promoter issue-preferred promoters can be utilized to target enhanced expression in certain cell types within a particular plant tissue, for instance vascular cells in leaves or roots or in specific cells of the seed. Examples of particular promoters for use in the AD-functionalized CRISPR system are found in Kawamata et al., (1997) Plant Cell Physiol 38:792-803; Yamamoto et al., (1997) Plant J 12:255-65; Hire et al, (1992) Plant Mol Biol 20:207-18, Kuster et al, (1995) Plant Mol Biol 29:759-72, and Capana et al., (1994) Plant Mol Biol 25:681-91.

Inducible promoters can be of interest to express one or more of the components of the AD-functionalized CRISPR system under limited circumstances to avoid non-specific activity of the deaminase. In particular embodiments, one or more elements of the AD-functionalized CRISPR system are expressed under control of an inducible promoter. Examples of promoters that are inducible and that allow for spatiotemporal control of gene editing or gene expression may use a form of energy. The form of energy may include but is not limited to sound energy, electromagnetic radiation, chemical energy and/or thermal energy. Examples of inducible systems include tetracycline inducible promoters (Tet-On or Tet-Off), small molecule two-hybrid transcription activations systems (FKBP, ABA, etc), or light inducible systems (Phytochrome, LOV domains, or cryptochrome), such as a Light Inducible Transcriptional Effector (LITE) that direct changes in transcriptional activity in a sequence-specific manner. The components of a light inducible system may include a fusion protein of adenosine deaminase and Cas13, a light-responsive cytochrome heterodimer (e.g. from *Arabidopsis thaliana*). Further examples of inducible DNA binding proteins and methods for their use are provided in U.S. 61/736,465 and U.S. 61/721,283, which is hereby incorporated by reference in its entirety.

In particular embodiments, transient or inducible expression can be achieved by using, for example, chemical-regulated promotors, i.e. whereby the application of an exogenous chemical induces gene expression. Modulating of gene expression can also be obtained by a chemical-repressible promoter, where application of the chemical represses gene expression. Chemical-inducible promoters include, but are not limited to, the maize ln2-2 promoter, activated by benzene sulfonamide herbicide safeners (De Veylder et al., (1997) Plant Cell Physiol 38:568-77), the maize GST promoter (GST-ll-27, WO93/01294), activated by hydrophobic electrophilic compounds used as pre-emergent herbicides, and the tobacco PR-1 a promoter (Ono et al., (2004) Biosci Biotechnol Biochem 68:803-7) activated by salicylic acid. Promoters which are regulated by antibiotics, such as tetracycline-inducible and tetracycline-repressible promoters (Gatz et al., (1991) Mol Gen Genet 227: 229-37; U.S. Pat. Nos. 5,814,618 and 5,789,156) can also be used herein.

Translocation to and/or Expression in Specific Plant Organelles

The expression system may comprise elements for translocation to and/or expression in a specific plant organelle.

Chloroplast Targeting

In particular embodiments, it is envisaged that the AD-functionalized CRISPR system is used to specifically modify chloroplast genes or to ensure expression in the chloroplast. For this purpose use is made of chloroplast transformation methods or compartmentalization of the AD-functionalized CRISPR components to the chloroplast. For instance, the introduction of genetic modifications in the plastid genome can reduce biosafety issues such as gene flow through pollen.

Methods of chloroplast transformation are known in the art and include Particle bombardment, PEG treatment, and microinjection. Additionally, methods involving the translocation of transformation cassettes from the nuclear genome to the plastid can be used as described in WO2010061186.

Alternatively, it is envisaged to target one or more of the AD-functionalized CRISPR components to the plant chloroplast. This is achieved by incorporating in the expression construct a sequence encoding a chloroplast transit peptide (CTP) or plastid transit peptide, operably linked to the 5' region of the sequence encoding the fusion protein of adenosine deaminase and Cas13. The CTP is removed in a processing step during translocation into the chloroplast. Chloroplast targeting of expressed proteins is well known to the skilled artisan (see for instance Protein Transport into Chloroplasts, 2010, Annual Review of Plant Biology, Vol. 61: 157-180). In such embodiments it is also desired to target the guide RNA to the plant chloroplast. Methods and constructs which can be used for translocating guide RNA into the chloroplast by means of a chloroplast localization sequence are described, for instance, in US 20040142476, incorporated herein by reference. Such variations of constructs can be incorporated into the expression systems of the invention to efficiently translocate the AD-functionalized CRISPR system components.

Introduction of Polynucleotides Encoding the AD-Functionalized CRISPR System in Algae Cells.

Transgenic algae (or other plants such as rape) may be particularly useful in the production of vegetable oils or biofuels such as alcohols (especially methanol and ethanol) or other products. These may be engineered to express or overexpress high levels of oil or alcohols for use in the oil or biofuel industries.

U.S. Pat. No. 8,945,839 describes a method for engineering Micro-Algae (*Chlamydomonas reinhardtii* cells) species) using Cas9. Using similar tools, the methods of the AD-functionalized CRISPR system described herein can be applied on *Chlamydomonas* species and other algae. In particular embodiments, a CRISPR-Cas protein (e.g., Cas13), adenosine deaminase (which may be fused to the CRISPR-Cas protein or an aptamer-binding adaptor protein), and guide RNA are introduced in algae expressed using a vector that expresses the fusion protein of adenosine deaminase and Cas13 under the control of a constitutive promoter such as Hsp70A-Rbc S2 or Beta2-tubulin. Guide RNA is optionally delivered using a vector containing T7 promoter. Alternatively, Cas13 mRNA and in vitro transcribed guide RNA can be delivered to algal cells. Electroporation protocols are available to the skilled person such as the standard recommended protocol from the GeneArt *Chlamydomonas* Engineering kit.

Introduction of AD-Functionalized CRISPR System Components in Yeast Cells

In particular embodiments, the invention relates to the use of the AD-functionalized CRISPR system for genome editing of yeast cells. Methods for transforming yeast cells which can be used to introduce polynucleotides encoding the AD-functionalized CRISPR system components are described in Kawai et al., 2010, Bioeng Bugs. 2010 Nov.-Dec.; 1(6): 395-403). Non-limiting examples include transformation of yeast cells by lithium acetate treatment (which may further include carrier DNA and PEG treatment), bombardment or by electroporation.

Transient Expression of AD-Functionalized CRISPR System Components in Plants and Plant Cell In particular embodiments, it is envisaged that the guide RNA and/or CRISPR-Cas gene are transiently expressed in the plant cell. In these embodiments, the AD-functionalized CRISPR system can ensure modification of a target gene only when both the guide RNA, the CRISPR-Cas protein (e.g., Cas13), and adenosine deaminase (which may be fused to the CRISPR-Cas protein or an aptamer-binding adaptor protein), are present in a cell, such that genomic modification can further be controlled. As the expression of the CRISPR-Cas protein is transient, plants regenerated from such plant cells typically contain no foreign DNA. In particular embodiments the CRISPR-Cas protein is stably expressed by the plant cell and the guide sequence is transiently expressed.

In particular embodiments, the AD-functionalized CRISPR system components can be introduced in the plant cells using a plant viral vector (Scholthof et al. 1996, Annu Rev Phytopathol. 1996; 34:299-323). In further particular embodiments, said viral vector is a vector from a DNA virus. For example, geminivirus (e.g., cabbage leaf curl virus, bean yellow dwarf virus, wheat dwarf virus, tomato leaf curl virus, maize streak virus, tobacco leaf curl virus, or tomato golden mosaic virus) or nanovirus (e.g., Faba bean necrotic yellow virus). In other particular embodiments, said viral vector is a vector from an RNA virus. For example, tobravirus (e.g., tobacco rattle virus, tobacco mosaic virus), potexvirus (e.g., potato virus X), or hordeivirus (e.g., barley stripe mosaic virus). The replicating genomes of plant viruses are non-integrative vectors.

In particular embodiments, the vector used for transient expression of AD-functionalized CRISPR system is for instance a pEAQ vector, which is tailored for *Agrobacterium*-mediated transient expression (Sainsbury F. et al., Plant Biotechnol J. 2009 Sep.; 7(7):682-93) in the protoplast. Precise targeting of genomic locations was demonstrated using a modified Cabbage Leaf Curl virus (CaLCuV) vector to express guide RNAs in stable transgenic plants expressing a CRISPR enzyme (Scientific Reports 5, Article number: 14926 (2015), doi:10.1038/srep14926).

In particular embodiments, double-stranded DNA fragments encoding the guide RNA and/or the CRISPR-Cas gene can be transiently introduced into the plant cell. In such embodiments, the introduced double-stranded DNA fragments are provided in sufficient quantity to modify the cell but do not persist after a contemplated period of time has passed or after one or more cell divisions. Methods for direct DNA transfer in plants are known by the skilled artisan (see for instance Davey et al. Plant Mol Biol. 1989 September; 13(3):273-85.)

In other embodiments, an RNA polynucleotide encoding the CRISPR-Cas protein (e.g., Cas13) and/or adenosine deaminase (which may be fused to the CRISPR-Cas protein or an aptamer-binding adaptor protein) is introduced into the plant cell, which is then translated and processed by the host cell generating the protein in sufficient quantity to modify the cell (in the presence of at least one guide RNA) but which does not persist after a contemplated period of time has passed or after one or more cell divisions. Methods for introducing mRNA to plant protoplasts for transient expression are known by the skilled artisan (see for instance in Gallie, Plant Cell Reports (1993), 13; 119-122).

Combinations of the different methods described above are also envisaged.

Delivery of AD-Functionalized CRISPR System Components to the Plant Cell

In particular embodiments, it is of interest to deliver one or more components of the AD-functionalized CRISPR system directly to the plant cell. This is of interest, inter alia, for the generation of non-transgenic plants (see below). In particular embodiments, one or more of the AD-functionalized CRISPR system components is prepared outside the plant or plant cell and delivered to the cell. For instance in particular embodiments, the CRISPR-Cas protein is prepared in vitro prior to introduction to the plant cell. The CRISPR-Cas protein can be prepared by various methods known by one of skill in the art and include recombinant production. After expression, the CRISPR-Cas protein is isolated, refolded if needed, purified and optionally treated to remove any purification tags, such as a His-tag. Once crude, partially purified, or more completely purified CRISPR-Cas protein is obtained, the protein may be introduced to the plant cell.

In particular embodiments, the CRISPR-Cas protein is mixed with guide RNA targeting the gene of interest to form a pre-assembled ribonucleoprotein.

The individual components or pre-assembled ribonucleoprotein can be introduced into the plant cell via electroporation, by bombardment with CRISPR-Cas-associated gene product coated particles, by chemical transfection or by some other means of transport across a cell membrane. For instance, transfection of a plant protoplast with a pre-assembled CRISPR ribonucleoprotein has been demonstrated to ensure targeted modification of the plant genome (as described by Woo et al. Nature Biotechnology, 2015; DOI: 10.1038/nbt.3389).

In particular embodiments, the AD-functionalized CRISPR system components are introduced into the plant cells using nanoparticles. The components, either as protein or nucleic acid or in a combination thereof, can be uploaded onto or packaged in nanoparticles and applied to the plants (such as for instance described in WO 2008042156 and US 20130185823). In particular, embodiments of the invention comprise nanoparticles uploaded with or packed with DNA molecule(s) encoding the CRISPR-Cas protein (e.g., Cas13), DNA molecule(s) encoding adenosine deaminase (which may be fused to the CRISPR-Cas protein or an aptamer-binding adaptor protein), and DNA molecules encoding the guide RNA and/or isolated guide RNA as described in WO2015089419.

Further means of introducing one or more components of the AD-functionalized CRISPR system to the plant cell is by using cell penetrating peptides (CPP). Accordingly, in particular, embodiments the invention comprises compositions comprising a cell penetrating peptide linked to the CRISPR-Cas protein. In particular embodiments of the present invention, the CRISPR-Cas protein and/or guide RNA is coupled to one or more CPPs to effectively transport them inside plant protoplasts. Ramakrishna (Genome Res. 2014 June; 24(6):1020-7 for Cas9 in human cells). In other embodiments, the CRISPR-Cas gene and/or guide RNA are encoded by one or more circular or non-circular DNA molecule(s) which are coupled to one or more CPPs for plant protoplast delivery. The plant protoplasts are then regenerated to plant cells and further to plants. CPPs are generally described as short peptides of fewer than 35 amino acids either derived from proteins or from chimeric sequences which are capable of transporting biomolecules across cell membrane in a receptor independent manner. CPP can be cationic peptides, peptides having hydrophobic sequences, amphipathic peptides, peptides having proline-rich and antimicrobial sequence, and chimeric or bipartite peptides (Pooga and Langel 2005). CPPs are able to penetrate biological membranes and as such trigger the movement of various biomolecules across cell membranes into the cytoplasm and to improve their intracellular routing, and hence facilitate interaction of the biomolecule with the target. Examples of CPP include amongst others: Tat, a nuclear transcriptional activator protein required for viral replication by HIV type1, penetratin, Kaposi fibroblast growth factor (FGF) signal peptide sequence, integrin 33 signal peptide sequence; polyarginine peptide Args sequence, Guanine rich-molecular transporters, sweet arrow peptide, etc.

Use of the AD-Functionalized CRISPR System to Make Genetically Modified Non-Transgenic Plants In particular embodiments, the methods described herein are used to modify endogenous genes or to modify their expression without the permanent introduction into the genome of the plant of any foreign gene, including those encoding CRISPR components, so as to avoid the presence of foreign DNA in the genome of the plant. This can be of interest as the regulatory requirements for non-transgenic plants are less rigorous.

In particular embodiments, this is ensured by transient expression of the AD-functionalized CRISPR system components. In particular embodiments one or more of the components are expressed on one or more viral vectors which produce sufficient CRISPR-Cas protein, adenosine deaminase, and guide RNA to consistently steadily ensure modification of a gene of interest according to a method described herein.

In particular embodiments, transient expression of AD-functionalized CRISPR system constructs is ensured in plant protoplasts and thus not integrated into the genome. The limited window of expression can be sufficient to allow the AD-functionalized CRISPR system to ensure modification of a target gene as described herein.

In particular embodiments, the different components of the AD-functionalized CRISPR system are introduced in the plant cell, protoplast or plant tissue either separately or in mixture, with the aid of particulate delivering molecules such as nanoparticles or CPP molecules as described herein above.

The expression of the AD-functionalized CRISPR system components can induce targeted modification of the genome, by deaminase activity of the adenosine deaminase. The different strategies described herein above allow CRISPR-mediated targeted genome editing without requiring the introduction of the AD-functionalized CRISPR system components into the plant genome. Components which are transiently introduced into the plant cell are typically removed upon crossing.

Plant Cultures and Regeneration

In particular embodiments, plant cells which have a modified genome and that are produced or obtained by any of the methods described herein, can be cultured to regenerate a whole plant which possesses the transformed or modified genotype and thus the desired phenotype. Conventional regeneration techniques are well known to those skilled in the art. Particular examples of such regeneration techniques rely on manipulation of certain phytohormones in a tissue culture growth medium, and typically relying on a biocide and/or herbicide marker which has been introduced together with the desired nucleotide sequences. In further particular embodiments, plant regeneration is obtained from cultured protoplasts, plant callus, explants, organs, pollens, embryos or parts thereof (see e.g. Evans et al. (1983), Handbook of Plant Cell Culture, Klee et al (1987) Ann. Rev. of Plant Phys.).

In particular embodiments, transformed or improved plants as described herein can be self-pollinated to provide seed for homozygous improved plants of the invention (homozygous for the DNA modification) or crossed with non-transgenic plants or different improved plants to provide seed for heterozygous plants. Where a recombinant DNA was introduced into the plant cell, the resulting plant of such a crossing is a plant which is heterozygous for the recombinant DNA molecule. Both such homozygous and heterozygous plants obtained by crossing from the improved plants and comprising the genetic modification (which can be a recombinant DNA) are referred to herein as "progeny". Progeny plants are plants descended from the original transgenic plant and containing the genome modification or recombinant DNA molecule introduced by the methods provided herein. Alternatively, genetically modified plants can be obtained by one of the methods described supra using the AD-functionalized CRISPR system whereby no foreign DNA is incorporated into the genome. Progeny of such plants, obtained by further breeding may also contain the genetic modification. Breedings are performed by any breeding methods that are commonly used for different crops (e.g., Allard, Principles of Plant Breeding, John Wiley & Sons, NY, U. of CA, Davis, CA, 50-98 (1960).

Generation of Plants with Enhanced Agronomic Traits

The AD-functionalized CRISPR systems provided herein can be used to introduce targeted A-G and T-C mutations. By co-expression of multiple targeting RNAs directed to achieve multiple modifications in a single cell, multiplexed genome modification can be ensured. This technology can be used to high-precision engineering of plants with improved characteristics, including enhanced nutritional quality, increased resistance to diseases and resistance to biotic and abiotic stress, and increased production of commercially valuable plant products or heterologous compounds.

In particular embodiments, the AD-functionalized CRISPR system as described herein is used to introduce targeted A-G and T-C mutations. Such mutation can be a nonsense mutation (e.g., premature stop codon) or a missense mutation (e.g., encoding different amino acid residue). This is of interest where the A-G and T-C mutations in certain endogenous genes can confer or contribute to a desired trait.

The methods described herein generally result in the generation of "improved plants" in that they have one or more desirable traits compared to the wildtype plant. In particular embodiments, the plants, plant cells or plant parts obtained are transgenic plants, comprising an exogenous DNA sequence incorporated into the genome of all or part of the cells of the plant. In particular embodiments, non-transgenic genetically modified plants, plant parts or cells are obtained, in that no exogenous DNA sequence is incorporated into the genome of any of the plant cells of the plant. In such embodiments, the improved plants are non-transgenic. Where only the modification of an endogenous gene is ensured and no foreign genes are introduced or maintained in the plant genome, the resulting genetically modified crops contain no foreign genes and can thus basically be considered non-transgenic.

In particular embodiments, the polynucleotides are delivered into the cell by a DNA virus (e.g., a geminivirus) or an RNA virus (e.g., a tobravirus). In particular embodiments, the introducing steps include delivering to the plant cell a T-DNA containing one or more polynucleotide sequences encoding the CRISPR-Cas protein, the adenosine deaminase, and the guide RNA, where the delivering is via *Agrobacterium*. The polynucleotide sequence encoding the components of the AD-functionalized CRISPR system can be operably linked to a promoter, such as a constitutive promoter (e.g., a cauliflower mosaic virus 35S promoter), or a cell specific or inducible promoter. In particular embodiments, the polynucleotide is introduced by microprojectile bombardment. In particular embodiments, the method further includes screening the plant cell after the introducing steps to determine whether the expression of the gene of interest has been modified. In particular embodiments, the methods include the step of regenerating a plant from the plant cell. In further embodiments, the methods include cross breeding the plant to obtain a genetically desired plant lineage.

In particular embodiments of the methods described above, disease resistant crops are obtained by targeted mutation of disease susceptibility genes or genes encoding negative regulators (e.g. Mlo gene) of plant defense genes. In a particular embodiment, herbicide-tolerant crops are generated by targeted substitution of specific nucleotides in plant genes such as those encoding acetolactate synthase (ALS) and protoporphyrinogen oxidase (PPO). In particular embodiments drought and salt tolerant crops by targeted mutation of genes encoding negative regulators of abiotic stress tolerance, low amylose grains by targeted mutation of Waxy gene, rice or other grains with reduced rancidity by targeted mutation of major lipase genes in aleurone layer, etc. In particular embodiments. A more extensive list of endogenous genes encoding a traits of interest are listed below.

Use of AD-Functionalized CRISPR System to Modify Polyploid Plants

Many plants are polyploid, which means they carry duplicate copies of their genomes—sometimes as many as six, as in wheat. The methods according to the present invention, which make use of the AD-functionalized CRISPR system can be "multiplexed" to affect all copies of a gene, or to target dozens of genes at once. For instance, in particular embodiments, the methods of the present invention are used to simultaneously ensure a loss of function mutation in different genes responsible for suppressing defences against a disease. In particular embodiments, the methods of the present invention are used to simultaneously suppress the expression of the TaMLO-A1, TaMLO-B1 and TaMLO-D1 nucleic acid sequence in a wheat plant cell and regenerating a wheat plant therefrom, in order to ensure that the wheat plant is resistant to powdery mildew (see also WO2015109752).

Exemplary Genes Conferring Agronomic Traits

In particular embodiments, the invention encompasses methods which involve targeted A-G and T-C mutations in endogenous genes and their regulatory elements, such as listed below:

1. Genes that confer resistance to pests or diseases:

Plant disease resistance genes. A plant can be transformed with cloned resistance genes to engineer plants that are resistant to specific pathogen strains. See, e.g., Jones et al., Science 266:789 (1994) (cloning of the tomato Cf-9 gene for resistance to *Cladosporium fulvum*); Martin et al., Science 262:1432 (1993) (tomato Pto gene for resistance to *Pseudomonas syringae* pv. tomato encodes a protein kinase); Mindrinos et al., Cell 78:1089 (1994) (*Arabidopsis* may be RSP2 gene for resistance to *Pseudomonas syringae*). A plant gene that is upregulated or down regulated during pathogen infection can be engineered for pathogen resistance. See, e.g., Thomazella et al., bioRxiv 064824; doi: doi.org/10.1101/064824 Epub. Jul. 23, 2016 (tomato plants with deletions in the SlDMR6-1 which is normally upregulated during pathogen infection).

Genes conferring resistance to a pest, such as soybean cyst nematode. See e.g., PCT Application WO 96/30517; PCT Application WO 93/19181.

*Bacillus thuringiensis* proteins see, e.g., Geiser et al., Gene 48:109 (1986).

Lectins, see, for example, Van Damme et al., Plant Molec. Biol. 24:25 (1994.

Vitamin-binding protein, such as avidin, see PCT application US93/06487, teaching the use of avidin and avidin homologues as larvicides against insect pests.

Enzyme inhibitors such as protease or proteinase inhibitors or amylase inhibitors. See, e.g., Abe et al., J. Biol. Chem. 262:16793 (1987), Huub et al., Plant Molec. Biol. 21:985 (1993)), Sumitani et al., Biosci. Biotech. Biochem. 57:1243 (1993) and U.S. Pat. No. 5,494,813.

Insect-specific hormones or pheromones such as ecdysteroid or juvenile hormone, a variant thereof, a mimetic based thereon, or an antagonist or agonist thereof. See, for example Hammock et al., Nature 344:458 (1990).

Insect-specific peptides or neuropeptides which, upon expression, disrupts the physiology of the affected pest. For example Regan, J. Biol. Chem. 269:9 (1994) and Pratt et al., Biochem. Biophys. Res. Comm. 163:1243 (1989). See also U.S. Pat. No. 5,266,317.

Insect-specific venom produced in nature by a snake, a wasp, or any other organism. For example, see Pang et al., Gene 116: 165 (1992).

Enzymes responsible for a hyperaccumulation of a monoterpene, a sesquiterpene, a steroid, hydroxamic acid, a phenylpropanoid derivative or another nonprotein molecule with insecticidal activity.

Enzymes involved in the modification, including the post-translational modification, of a biologically active molecule; for example, a glycolytic enzyme, a proteolytic enzyme, a lipolytic enzyme, a nuclease, a cyclase, a transaminase, an esterase, a hydrolase, a phosphatase, a kinase, a phosphorylase, a polymerase, an elastase, a chitinase and a glucanase, whether natural or synthetic. See PCT application WO93/02197, Kramer et al., Insect Biochem. Molec. Biol. 23:691 (1993) and Kawalleck et al., Plant Molec. Biol. 21:673 (1993).

Molecules that stimulates signal transduction. For example, see Botella et al., Plant Molec. Biol. 24:757 (1994), and Griess et al., Plant Physiol. 104:1467 (1994).

Viral-invasive proteins or a complex toxin derived therefrom. See Beachy et al., Ann. rev. Phytopathol. 28:451 (1990).

Developmental-arrestive proteins produced in nature by a pathogen or a parasite. See Lamb et al., Bio/Technology 10:1436 (1992) and Toubart et al., Plant J. 2:367 (1992).

A developmental-arrestive protein produced in nature by a plant. For example, Logemann et al., Bio/Technology 10:305 (1992).

In plants, pathogens are often host-specific. For example, some *Fusarium* species will causes tomato wilt but attacks only tomato, and other *Fusarium* species attack only wheat. Plants have existing and induced defenses to resist most pathogens. Mutations and recombination events across plant generations lead to genetic variability that gives rise to susceptibility, especially as pathogens reproduce with more frequency than plants. In plants there can be non-host resistance, e.g., the host and pathogen are incompatible or there can be partial resistance against all races of a pathogen, typically controlled by many genes and/or also complete resistance to some races of a pathogen but not to other races. Such resistance is typically controlled by a few genes. Using methods and components of the AD-functionalized CRISPR system, a new tool now exists to induce specific mutations in anticipation hereon. Accordingly, one can analyze the genome of sources of resistance genes, and in plants having desired characteristics or traits, use the method and components of the AD-functionalized CRISPR system to induce the rise of resistance genes. The present systems can do so with more precision than previous mutagenic agents and hence accelerate and improve plant breeding programs.

2. Genes involved in plant diseases, such as those listed in WO 2013046247:

Rice diseases: *Magnaporthe grisea, Cochliobolus miyabeanus, Rhizoctonia solani, Gibberella fujikuroi*; Wheat diseases: *Erysiphe graminis, Fusarium graminearum, F. avenaceum, F. culmorum, Microdochium nivale, Puccinia striiformis, P. graminis, P. recondita, Micronectriella nivale, Typhula sp., Ustilago tritici, Tilletia caries, Pseudocercosporella herpotrichoides, Mycosphaerella graminicola, Stagonospora nodorum, Pyrenophora tritici-repentis*; Barley diseases: *Erysiphe graminis, Fusarium graminearum, F. avenaceum, F. culmorum, Microdochium nivale, Puccinia striiformis, P. graminis, P. hordei, Ustilago nuda, Rhynchosporium secalis, Pyrenophora teres, Cochliobolus sativus, Pyrenophora graminea, Rhizoctonia solani*; Maize diseases: *Ustilago maydis, Cochliobolus heterostrophus, Gloeocercospora sorghi, Puccinia polysora, Cercospora zeae-maydis, Rhizoctonia solani;*

Citrus diseases: *Diaporthe citri, Elsinoe fawcetti, Penicillium digitatum, P. italicum, Phytophthora parasitica, Phytophthora citrophthora*; Apple diseases: *Monilinia mali, Valsa ceratosperma, Podosphaera leucotricha, Alternaria alternata* apple pathotype, *Venturia inaequalis, Colletotrichum acutatum, Phytophthora cactorum;*

Pear diseases: *Venturia nashicola, V. pirina, Alternaria alternata* Japanese pear pathotype, *Gymnosporangium haraeanum, Phytophthora cactorum;*

Peach diseases: *Monilinia fructicola, Cladosporium carpophilum, Phomopsis* sp.;

Grape diseases: *Elsinoe ampelina, Glomerella cingulata, Uncinula necator, Phakopsora ampelopsidis, Guignardia bidwellii, Plasmopara viticola;*

Persimmon diseases: *Gloeosporium kaki, Cercospora kaki, Mycosphaerella nawae;*

Gourd diseases: *Colletotrichum lagenarium, Sphaerotheca fuliginea, Mycosphaerella melonis, Fusarium oxysporum, Pseudoperonospora cubensis, Phytophthora* sp., *Pythium* sp.;

Tomato diseases: *Alternaria solani, Cladosporium fulvum, Phytophthora infestans; Pseudomonas syringae* pv. Tomato; *Phytophthora capsici; Xanthomonas*

Eggplant diseases: *Phomopsis vexans, Erysiphe cichoracearum*; Brassicaceous vegetable diseases: *Alternaria japonica, Cercosporella brassicae, Plasmodiophora brassicae, Peronospora parasitica;*

Welsh onion diseases: *Puccinia allii, Peronospora destructor;*

Soybean diseases: *Cercospora kikuchii, Elsinoe glycines, Diaporthe phaseolorum* var. *sojae, Septoria glycines, Cercospora sojina, Phakopsora pachyrhizi, Phytophthora sojae, Rhizoctonia solani, Corynespora cassiicola, Sclerotinia sclerotiorum;*

Kidney bean diseases: *Colletotrichum lindemuthianum;*

Peanut diseases: *Cercospora personata, Cercospora arachidicola, Sclerotium rolfsii;*

Pea diseases pea: *Erysiphe pisi;*

Potato diseases: *Alternaria solani, Phytophthora infestans, Phytophthora erythroseptica, Spongospora subterranean,* f. sp. *Subterranean;*

Strawberry diseases: *Sphaerotheca humuli, Glomerella cingulata;*

Tea diseases: *Exobasidium reticulatum, Elsinoe leucospila, Pestalotiopsis* sp., *Colletotrichum theae-sinensis;*

Tobacco diseases: *Alternaria longipes, Erysiphe cichoracearum, Colletotrichum tabacum, Peronospora tabacina, Phytophthora nicotianae;*

Rapeseed diseases: *Sclerotinia sclerotiorum, Rhizoctonia solani;*

Cotton diseases: *Rhizoctonia solani;*

Beet diseases: *Cercospora beticola, Thanatephorus cucumeris, Thanatephorus cucumeris, Aphanomyces cochlioides;*

Rose diseases: *Diplocarpon rosae, Sphaerotheca pannosa, Peronospora sparsa;*

Diseases of chrysanthemum and asteraceae: *Bremia lactuca, Septoria chrysanthemi-indici, Puccinia horiana;*

Diseases of various plants: *Pythium aphanidermatum, Pythium debaryanum, Pythium graminicola, Pythium irregulare, Pythium ultimum, Botrytis cinerea, Sclerotinia sclerotiorum;*

Radish diseases: *Alternaria brassicicola;*

Zoysia diseases: *Sclerotinia homoeocarpa, Rhizoctonia solani;*

Banana diseases: *Mycosphaerella fijiensis, Mycosphaerella musicola;*

Sunflower diseases: *Plasmopara halstedii;*

Seed diseases or diseases in the initial stage of growth of various plants caused by *Aspergillus* spp., *Penicillium* spp., *Fusarium* spp., *Gibberella* spp., *Tricoderma* spp., *Thielaviopsis* spp., *Rhizopus* spp., *Mucor* spp., *Corticium* spp., *Rhoma* spp., *Rhizoctonia* spp., *Diplodia* spp., or the like;

Virus diseases of various plants mediated by *Polymyxa* spp., *Olpidium* spp., or the like.

3. Examples of genes that confer resistance to herbicides:

Resistance to herbicides that inhibit the growing point or meristem, such as an imidazolinone or a sulfonylurea, for example, by Lee et al., EMBO J. 7:1241 (1988), and Miki et al., Theor. Appl. Genet. 80:449 (1990), respectively.

Glyphosate tolerance (resistance conferred by, e.g., mutant 5-enolpyruvylshikimate-3-phosphate synthase (EPSPs) genes, aroA genes and glyphosate acetyl transferase (GAT) genes, respectively), or resistance to other phosphono compounds such as by glufosinate (phosphinothricin acetyl transferase (PAT) genes from *Streptomyces* species, including *Streptomyces hygroscopicus* and *Streptomyces viridochromogenes*), and to pyridinoxy or phenoxy propionic acids and cyclohexones by ACCase inhibitor-encoding genes. See, for example, U.S. Pat. Nos. 4,940,835 and 6,248,876, 4,769,061, EP No. 0 333 033 and U.S. Pat. No. 4,975,374. See also EP No. 0242246, DeGreef et al., Bio/Technology 7:61 (1989), Marshall et al., Theor. Appl. Genet. 83:435 (1992), WO 2005012515 to Castle et. al. and WO 2005107437.

Resistance to herbicides that inhibit photosynthesis, such as a triazine (psbA and gs+ genes) or a benzonitrile (nitrilase gene), and glutathione S-transferase in Przibila et al., Plant Cell 3:169 (1991), U.S. Pat. No. 4,810,648, and Hayes et al., Biochem. J. 285: 173 (1992).

Genes encoding Enzymes detoxifying the herbicide or a mutant glutamine synthase enzyme that is resistant to inhibition, e.g. n U.S. patent application Ser. No. 11/760,602. Or a detoxifying enzyme is an enzyme encoding a phosphinothricin acetyltransferase (such as the bar or pat protein from *Streptomyces* species). Phosphinothricin acetyltransferases are for example described in U.S. Pat. Nos. 5,561,236; 5,648,477; 5,646,024; 5,273,894; 5,637,489; 5,276,268; 5,739,082; 5,908,810 and 7,112,665.

Hydroxyphenylpyruvatedioxygenases (HPPD) inhibitors, naturally occurring HPPD resistant enzymes, or genes encoding a mutated or chimeric HPPD enzyme as described in WO 96/38567, WO 99/24585, and WO 99/24586, WO 2009/144079, WO 2002/046387, or U.S. Pat. No. 6,768,044.

4. Examples of genes involved in Abiotic stress tolerance:

Transgene capable of reducing the expression and/or the activity of poly(ADP-ribose) polymerase (PARP) gene in the plant cells or plants as described in WO 00/04173 or, WO/2006/045633.

Transgenes capable of reducing the expression and/or the activity of the PARG encoding genes of the plants or plants cells, as described e.g. in WO 2004/090140.

Transgenes coding for a plant-functional enzyme of the nicotineamide adenine dinucleotide salvage synthesis pathway including nicotinamidase, nicotinate phosphoribosyltransferase, nicotinic acid mononucleotide adenyl transferase, nicotinamide adenine dinucleotide synthetase or nicotine amide phosphoribosyltransferase as described e.g. in EP 04077624.7, WO 2006/133827, PCT/EP07/002,433, EP 1999263, or WO 2007/107326.

Enzymes involved in carbohydrate biosynthesis include those described in e.g. EP 0571427, WO 95/04826, EP 0719338, WO 96/15248, WO 96/19581, WO 96/27674, WO 97/11188, WO 97/26362, WO 97/32985, WO 97/42328, WO 97/44472, WO 97/45545, WO 98/27212, WO 98/40503, WO99/58688, WO 99/58690, WO 99/58654, WO 00/08184, WO 00/08185, WO 00/08175, WO 00/28052, WO 00/77229, WO 01/12782, WO 01/12826, WO 02/101059, WO 03/071860, WO 2004/056999, WO 2005/030942, WO 2005/030941, WO 2005/095632, WO 2005/095617, WO 2005/095619, WO 2005/095618, WO 2005/123927, WO 2006/018319, WO 2006/103107, WO 2006/108702, WO 2007/009823, WO 00/22140, WO 2006/063862, WO 2006/072603, WO 02/034923, EP 06090134.5, EP 06090228.5, EP 06090227.7, EP 07090007.1, EP 07090009.7, WO 01/14569, WO 02/79410, WO 03/33540, WO 2004/078983, WO 01/19975, WO 95/26407, WO 96/34968, WO 98/20145, WO 99/12950, WO 99/66050, WO 99/53072, U.S. Pat. No. 6,734,341, WO 00/11192, WO 98/22604, WO 98/32326, WO 01/98509, WO 01/98509, WO 2005/002359, U.S. Pat. Nos. 5,824,790, 6,013,861, WO 94/04693, WO 94/09144, WO 94/11520, WO 95/35026 or WO 97/20936 or enzymes involved in the production of polyfructose, especially of the inulin and levan-type, as disclosed in EP 0663956, WO 96/01904, WO 96/21023, WO 98/39460, and WO 99/24593, the production of alpha-1,4-glucans as disclosed in WO 95/31553, US 2002031826, U.S. Pat. Nos. 6,284,479, 5,712,107, WO 97/47806, WO 97/47807, WO 97/47808 and WO 00/14249, the production of alpha-1,6 branched alpha-1,4-glucans, as disclosed in WO 00/73422, the production of alternan, as disclosed in e.g. WO 00/47727, WO 00/73422, EP 06077301.7, U.S. Pat. No. 5,908,975 and EP 0728213, the production of hyaluronan, as for example disclosed in WO 2006/032538, WO 2007/039314, WO 2007/039315, WO 2007/039316, JP 2006304779, and WO 2005/012529.

Genes that improve drought resistance. For example, WO 2013122472 discloses that the absence or reduced level of functional Ubiquitin Protein Ligase protein (UPL) protein, more specifically, UPL3, leads to a decreased need for water or improved resistance to drought of said plant. Other examples of transgenic plants with increased drought tolerance are disclosed in, for example, US 2009/0144850, US 2007/0266453, and WO 2002/083911. US2009/0144850 describes a plant displaying a drought tolerance phenotype due to altered expression of a DR02 nucleic acid. US 2007/0266453 describes a plant displaying a drought tolerance phenotype due to altered expression of a DR03 nucleic acid and WO 2002/08391 1 describes a plant having an increased tolerance to drought stress due to a reduced activity of an ABC transporter which is expressed in guard cells. Another example is the work by Kasuga and co-authors (1999), who describe that overexpression of cDNA encoding DREB1 A in transgenic plants activated the expression of many stress tolerance genes under normal growing conditions and resulted in improved tolerance to drought, salt loading, and freezing. However, the expression of DREB1A also resulted in severe growth retardation under normal growing conditions (Kasuga (1999) Nat Biotechnol 17(3) 287-291).

In further particular embodiments, crop plants can be improved by influencing specific plant traits. For example, by developing pesticide-resistant plants, improving disease resistance in plants, improving plant insect and nematode resistance, improving plant resistance against parasitic weeds, improving plant drought tolerance, improving plant nutritional value, improving plant stress tolerance, avoiding self-pollination, plant forage digestibility biomass, grain yield etc. A few specific non-limiting examples are provided hereinbelow.

In addition to targeted mutation of single genes, AD-functionalized CRISPR system can be designed to allow targeted mutation of multiple genes, deletion of chromosomal fragment, site-specific integration of transgene, site-directed mutagenesis in vivo, and precise gene replacement or allele swapping in plants. Therefore, the methods described herein have broad applications in gene discovery and validation, mutational and cisgenic breeding, and hybrid breeding. These applications facilitate the production of a new generation of genetically modified crops with various improved agronomic traits such as herbicide resistance, disease resistance, abiotic stress tolerance, high yield, and superior quality.

Use of AD-Functionalized CRISPR System to Create Male Sterile Plants

Hybrid plants typically have advantageous agronomic traits compared to inbred plants. However, for self-pollinating plants, the generation of hybrids can be challenging. In different plant types, genes have been identified which are important for plant fertility, more particularly male fertility. For instance, in maize, at least two genes have been identified which are important in fertility (Amitabh Mohanty International Conference on New Plant Breeding Molecular Technologies Technology Development And Regulation, Oct. 9-10, 2014, Jaipur, India; Svitashev et al. Plant Physiol. 2015 October; 169(2):931-45; Djukanovic et al. Plant J. 2013 December; 76(5):888-99). The methods and systems provided herein can be used to target genes required for male fertility so as to generate male sterile plants which can easily be crossed to generate hybrids. In particular embodiments, the AD-functionalized CRISPR system provided herein is used for targeted mutagenesis of the cytochrome P450-like gene (MS26) or the meganuclease gene (MS45) thereby conferring male sterility to the maize plant. Maize plants which are as such genetically altered can be used in hybrid breeding programs.

Increasing the Fertility Stage in Plants

In particular embodiments, the methods and systems provided herein are used to prolong the fertility stage of a plant such as of a rice plant. For instance, a rice fertility stage gene such as Ehd3 can be targeted in order to generate a mutation in the gene and plantlets can be selected for a prolonged regeneration plant fertility stage (as described in CN 104004782)

Use of AD-Functionalized CRISPR System to Generate Genetic Variation in a Crop of Interest The availability of wild germplasm and genetic variations in crop plants is the key to crop improvement programs, but the available diversity in germplasms from crop plants is limited. The present invention envisages methods for generating a diversity of genetic variations in a germplasm of interest. In this application of the AD-functionalized CRISPR system a library of guide RNAs targeting different locations in the plant genome is provided and is introduced into plant cells together with the CRISPR-Cas protein and adenosine deaminase. In this way a collection of genome-scale point mutations and gene knock-outs can be generated. In particular embodiments, the methods comprise generating a plant part or plant from the cells so obtained and screening the cells for a trait of interest. The target genes can include both coding and non-coding regions. In particular embodiments, the trait is stress tolerance and the method is a method for the generation of stress-tolerant crop varieties.

Use of AD-Functionalized CRISPR to Affect Fruit-Ripening

Ripening is a normal phase in the maturation process of fruits and vegetables. Only a few days after it starts it renders a fruit or vegetable inedible. This process brings significant losses to both farmers and consumers. In particular embodiments, the methods of the present invention are used to reduce ethylene production. This is ensured by ensuring one or more of the following: a. Suppression of ACC synthase gene expression. ACC (1-aminocyclopropane-1-carboxylic acid) synthase is the enzyme responsible for the conversion of S-adenosylmethionine (SAM) to ACC; the second to the last step in ethylene biosynthesis. Enzyme expression is hindered when an antisense ("mirror-image") or truncated copy of the synthase gene is inserted into the plant's genome; b. Insertion of the ACC deaminase gene. The gene coding for the enzyme is obtained from *Pseudomonas chlororaphis*, a common nonpathogenic soil bacterium. It converts ACC to a different compound thereby reducing the amount of ACC available for ethylene production; c. Insertion of the SAM hydrolase gene. This approach is similar to ACC deaminase wherein ethylene production is hindered when the amount of its precursor metabolite is reduced; in this case SAM is converted to homoserine. The gene coding for the enzyme is obtained from *E. coli* T3 bacteriophage and d. Suppression of ACC oxidase gene expression. ACC oxidase is the enzyme which catalyzes the oxidation of ACC to ethylene, the last step in the ethylene biosynthetic pathway. Using the methods described herein, down regulation of the ACC oxidase gene results in the suppression of ethylene production, thereby delaying fruit ripening. In particular embodiments, additionally or alternatively to the modifications described above, the methods described herein are used to modify ethylene receptors, so as to interfere with ethylene signals obtained by the fruit. In particular embodiments, expression of the ETR1 gene, encoding an ethylene binding protein is modified, more particularly suppressed. In particular embodiments, additionally or alternatively to the modifications described above, the methods described herein are used to modify expression of the gene encoding Polygalacturonase (PG), which is the enzyme responsible for the breakdown of pectin, the substance that maintains the integrity of plant cell walls. Pectin breakdown occurs at the start of the ripening process resulting in the softening of the fruit. Accordingly, in particular embodiments, the methods described herein are used to introduce a mutation in the PG gene or to suppress activation of the PG gene in order to reduce the amount of PG enzyme produced thereby delaying pectin degradation.

Thus in particular embodiments, the methods comprise the use of the AD-functionalized CRISPR system to ensure one or more modifications of the genome of a plant cell such as described above, and regenerating a plant therefrom. In particular embodiments, the plant is a tomato plant.

Increasing Storage Life of Plants

In particular embodiments, the methods of the present invention are used to modify genes involved in the production of compounds which affect storage life of the plant or plant part. More particularly, the modification is in a gene that prevents the accumulation of reducing sugars in potato tubers. Upon high-temperature processing, these reducing sugars react with free amino acids, resulting in brown, bitter-tasting products and elevated levels of acrylamide, which is a potential carcinogen. In particular embodiments, the methods provided herein are used to reduce or inhibit expression of the vacuolar invertase gene (VInv), which encodes a protein that breaks down sucrose to glucose and fructose (Clasen et al. DOI: 10.1111/pbi.12370).

The Use of the AD-Functionalized CRISPR System to Ensure a Value Added Trait

In particular embodiments the AD-functionalized CRISPR system is used to produce nutritionally improved agricultural crops. In particular embodiments, the methods provided herein are adapted to generate "functional foods", i.e. a modified food or food ingredient that may provide a health benefit beyond the traditional nutrients it contains and/or "nutraceutical", i.e. substances that may be considered a food or part of a food and provides health benefits, including the prevention and treatment of disease. In particular embodiments, the nutraceutical is useful in the prevention and/or treatment of one or more of cancer, diabetes, cardiovascular disease, and hypertension.

Examples of nutritionally improved crops include (Newell-McGloughlin, Plant Physiology, July 2008, Vol. 147, pp. 939-953):

Modified protein quality, content and/or amino acid composition, such as have been described for Bahiagrass (Luciani et al. 2005, Florida Genetics Conference Poster), Canola (Roesler et al., 1997, Plant Physiol 113 75-81), Maize (Cromwell et al, 1967, 1969 J Anim Sci 26 1325-1331, O'Quin et al. 2000 J Anim Sci 78 2144-2149, Yang et al. 2002, Transgenic Res 11 11-20, Young et al. 2004, Plant J 38 910-922), Potato (Yu J and Ao, 1997 Acta Bot Sin 39 329-334; Chakraborty et al. 2000, Proc Natl Acad Sci USA 97 3724-3729; Li et al. 2001) Chin Sci Bull 46 482-484, Rice (Katsube et al. 1999, Plant Physiol 120 1063-1074), Soybean (Dinkins et al. 2001, Rapp 2002, In Vitro Cell Dev Biol Plant 37 742-747), Sweet Potato (Egnin and Prakash 1997, In Vitro Cell Dev Biol 33 52A).

Essential amino acid content, such as has been described for Canola (Falco et al. 1995, Bio/Technology 13 577-582), Lupin (White et al. 2001, J Sci Food Agric 81 147-154), Maize (Lai and Messing, 2002, Agbios 2008 GM crop database (Mar. 11, 2008)), Potato (Zeh et al. 2001, Plant Physiol 127 792-802), Sorghum (Zhao et al. 2003, Kluwer Academic Publishers, Dordrecht, The Netherlands, pp 413-416), Soybean (Falco et al. 1995 Bio/Technology 13 577-582; Galili et al. 2002 Crit Rev Plant Sci 21 167-204).

Oils and Fatty acids such as for Canola (Dehesh et al. (1996) Plant J 9 167-172 [PubMed]; Del Vecchio (1996) INFORM International News on Fats, Oils and Related Materials 7 230-243; Roesler et al. (1997) Plant Physiol 113 75-81 [PMC free article][PubMed]; Froman and Ursin (2002, 2003) Abstracts of Papers of the American Chemical Society 223 U35; James et al. (2003) Am J Clin Nutr 77 1140-1145 [PubMed]; Agbios (2008, above); coton (Chapman et al. (2001). J Am Oil Chem Soc 78 941-947; Liu et al. (2002) J Am Coll Nutr 21 205S-211S [PubMed]; O'Neill (2007) Australian Life Scientist. biotechnews.com.au/ind-ex.php/id; 866694817;fp;4;fpid; 2 (Jun. 17, 2008), Linseed (Abbadi et al., 2004, Plant Cell 16: 2734-2748), Maize (Young et al., 2004, Plant J 38 910-922), oil palm (Jalani et al. 1997, J Am Oil Chem Soc 74 1451-1455; Parveez, 2003, AgBiotechNet 113 1-8), Rice (Anai et al., 2003, Plant Cell Rep 21 988-992), Soybean (Reddy and Thomas, 1996, Nat Biotechnol 14 639-642; Kinney and Kwolton, 1998, Blackie Academic and Professional, London, pp 193-213), Sunflower (Arcadia, Biosciences 2008)

Carbohydrates, such as Fructans described for Chicory (Smeekens (1997) Trends Plant Sci 2 286-287, Sprenger et al. (1997) FEBS Lett 400 355-358, Sevenier et al. (1998) Nat Biotechnol 16 843-846), Maize (Caimi et al. (1996) Plant Physiol 110 355-363), Potato (Hellwege et al.,1997 Plant J 12 1057-1065), Sugar Beet (Smeekens et al. 1997, above), Inulin, such as described for Potato (Hellewege et al. 2000, Proc Natl Acad Sci USA 97 8699-8704), Starch, such as described for Rice (Schwall et al. (2000) Nat Biotechnol 18 551-554, Chiang et al. (2005) Mol Breed 15 125-143), Vitamins and carotenoids, such as described for Canola (Shintani and DellaPenna (1998) Science 282 2098-2100), Maize (Rocheford et al. (2002). J Am Coll Nutr 21 191S-198S, Cahoon et al. (2003) Nat Biotechnol 21 1082-1087, Chen et al. (2003) Proc Natl Acad Sci USA 100 3525-3530), Mustardseed (Shewmaker et al. (1999) Plant J 20 401-412, Potato (Ducreux et al., 2005, J Exp Bot 56 81-89), Rice (Ye et al. (2000) Science 287 303-305, Strawberry (Agius et al. (2003), Nat Biotechnol 21 177-181), Tomato (Rosati et al. (2000) Plant J 24 413-419, Fraser et al. (2001) J Sci Food Agric 81 822-827, Mehta et al. (2002) Nat Biotechnol 20 613-618, Diaz de la Garza et al. (2004) Proc Natl Acad Sci USA 101 13720-13725, Enfissi et al. (2005) Plant Biotechnol J 3 17-27, DellaPenna (2007) Proc Natl Acad Sci USA 104 3675-3676.

Functional secondary metabolites, such as described for Apple (stilbenes, Szankowski et al. (2003) Plant Cell Rep 22: 141-149), Alfalfa (resveratrol, Hipskind and Paiva (2000) Mol Plant Microbe Interact 13 551-562), Kiwi (resveratrol, Kobayashi et al. (2000) Plant Cell Rep 19 904-910), Maize and Soybean (flavonoids, Yu et al. (2000) Plant Physiol 124 781-794), Potato (anthocyanin and alkaloid glycoside, Lukaszewicz et al. (2004) J Agric Food Chem 52 1526-1533), Rice (flavonoids & resveratrol, Stark-Lorenzen et al. (1997) Plant Cell Rep 16 668-673, Shin et al. (2006) Plant Biotechnol J 4 303-315), Tomato (+resveratrol, chlorogenic acid, flavonoids, stilbene; Rosati et al. (2000) above, Muir et al. (2001) Nature 19 470-474, Niggeweg et al. (2004) Nat Biotechnol 22 746-754, Giovinazzo et al. (2005) Plant Biotechnol J 3 57-69), wheat (caffeic and ferulic acids, resveratrol; United Press International (2002)); and Mineral availabilities such as described for Alfalfa (phytase, Austin-Phillips et al. (1999) molecularfarming-.com/nonmedical.html), Lettuce (iron, Goto et al. (2000) Theor Appl Genet 100 658-664), Rice (iron, Lucca et al. (2002) J Am Coll Nutr 21 184S-190S), Maize, Soybean and wheat (phytase, Drakakaki et al. (2005) Plant Mol Biol 59 869-880, Denbow et al. (1998) Poult Sci 77 878-881, Brinch-Pedersen et al. (2000) Mol Breed 6 195-206).

In particular embodiments, the value-added trait is related to the envisaged health benefits of the compounds present in the plant. For instance, in particular embodiments, the value-added crop is obtained by applying the methods of the invention to ensure the modification of or induce/increase the synthesis of one or more of the following compounds:

Carotenoids, such as α-Carotene present in carrots which Neutralizes free radicals that may cause damage to cells or β-Carotene present in various fruits and vegetables which neutralizes free radicals;

Lutein present in green vegetables which contributes to maintenance of healthy vision;

Lycopene present in tomato and tomato products, which is believed to reduce the risk of prostate cancer;

Zeaxanthin, present in citrus and maize, which contributes to maintenance of healthy vision Dietary fiber such as insoluble fiber present in wheat bran which may reduce the risk of breast and/or colon cancer and β-Glucan present in oat, soluble fiber present in Psyllium and whole cereal grains which may reduce the risk of cardiovascular disease (CVD);

Fatty acids, such as ω-3 fatty acids which may reduce the risk of CVD and improve mental and visual functions, Conjugated linoleic acid, which may improve body composition, may decrease risk of certain cancers and GLA which may reduce inflammation risk of cancer and CVD, may improve body composition;

Flavonoids such as Hydroxycinnamates, present in wheat which have Antioxidant-like activities, may reduce risk of degenerative diseases, flavonols, catechins and tannins present in fruits and vegetables which neutralize free radicals and may reduce risk of cancer;

Glucosinolates, indoles, isothiocyanates, such as Sulforaphane, present in Cruciferous vegetables (broccoli, kale), horseradish, which neutralize free radicals, may reduce risk of cancer;

Phenolics, such as stilbenes present in grape which May reduce risk of degenerative diseases, heart disease, and cancer, may have longevity effect and caffeic acid and ferulic acid present in vegetables and citrus which have Antioxidant-like activities, may reduce risk of degenerative diseases, heart disease, and eye disease, and epicatechin present in cacao which has Antioxidant-like activities, may reduce risk of degenerative diseases and heart disease;

Plant stanols/sterols present in maize, soy, wheat and wooden oils which May reduce risk of coronary heart disease by lowering blood cholesterol levels;

Fructans, inulins, fructo-oligosaccharides present in Jerusalem artichoke, shallot, onion powder which may improve gastrointestinal health;

Saponins present in soybean, which may lower LDL cholesterol;

Soybean protein present in soybean which may reduce risk of heart disease;

Phytoestrogens such as isoflavones present in soybean which May reduce menopause symptoms, such as hot flashes, may reduce osteoporosis and CVD and lignans present in flax, rye and vegetables, which May protect against heart disease and some cancers, may lower LDL cholesterol, total cholesterol;

Sulfides and thiols such as diallyl sulphide present in onion, garlic, olive, leek and scallion and Allyl methyl trisulfide, dithiolthiones present in cruciferous vegetables which may lower LDL cholesterol, helps to maintain healthy immune system; and Tannins, such as proanthocyanidins, present in cranberry, cocoa, which may improve urinary tract health, may reduce risk of CVD and high blood pressure.

In addition, the methods of the present invention also envisage modifying protein/starch functionality, shelf life, taste/aesthetics, fiber quality, and allergen, antinutrient, and toxin reduction traits.

Accordingly, the invention encompasses methods for producing plants with nutritional added value, said methods comprising introducing into a plant cell a gene encoding an enzyme involved in the production of a component of added nutritional value using the AD-functionalized CRISPR system as described herein and regenerating a plant from said plant cell, said plant characterized in an increase expression of said component of added nutritional value. In particular embodiments, the AD-functionalized CRISPR system is used to modify the endogenous synthesis of these compounds indirectly, e.g. by modifying one or more transcription factors that controls the metabolism of this compound. Methods for introducing a gene of interest into a plant cell and/or modifying an endogenous gene using the AD-functionalized CRISPR system are described herein above.

Some specific examples of modifications in plants that have been modified to confer value-added traits are: plants with modified fatty acid metabolism, for example, by transforming a plant with an antisense gene of stearyl-ACP desaturase to increase stearic acid content of the plant. See Knultzon et al., Proc. Natl. Acad. Sci. U.S.A. 89:2624 (1992). Another example involves decreasing phytate content, for example by cloning and then reintroducing DNA associated with the single allele which may be responsible for maize mutants characterized by low levels of phytic acid. See Raboy et al, Maydica 35:383 (1990).

Similarly, expression of the maize (*Zea mays*) Tfs C1 and R, which regulate the production of flavonoids in maize aleurone layers under the control of a strong promoter, resulted in a high accumulation rate of anthocyanins in *Arabidopsis* (*Arabidopsis thaliana*), presumably by activating the entire pathway (Bruce et al., 2000, Plant Cell 12:65-80). DellaPenna (Welsch et al., 2007 Annu Rev Plant Biol 57: 711-738) found that Tf RAP2.2 and its interacting partner SINAT2 increased carotenogenesis in *Arabidopsis* leaves. Expressing the Tf Dof1 induced the up-regulation of genes encoding enzymes for carbon skeleton production, a marked increase of amino acid content, and a reduction of the Glc level in transgenic *Arabidopsis* (Yanagisawa, 2004 Plant Cell Physiol 45: 386-391), and the DOF Tf AtDof1.1 (OBP2) up-regulated all steps in the glucosinolate biosynthetic pathway in *Arabidopsis* (Skirycz et al., 2006 Plant J 47: 10-24).

Reducing Allergen in Plants

In particular embodiments the methods provided herein are used to generate plants with a reduced level of allergens, making them safer for the consumer. In particular embodiments, the methods comprise modifying expression of one or more genes responsible for the production of plant allergens. For instance, in particular embodiments, the methods comprise down-regulating expression of a Lol p5 gene in a plant cell, such as a ryegrass plant cell and regenerating a plant therefrom so as to reduce allergenicity of the pollen of said plant (Bhalla et al. 1999, Proc. Natl. Acad. Sci. USA Vol. 96: 11676-11680).

Peanut allergies and allergies to legumes generally are a real and serious health concern. The AD-functionalized CRISPR system of the present invention can be used to identify and then mutate genes encoding allergenic proteins of such legumes. Without limitation as to such genes and proteins, Nicolaou et al. identifies allergenic proteins in peanuts, soybeans, lentils, peas, lupin, green beans, and mung beans. See, Nicolaou et al., Current Opinion in Allergy and Clinical Immunology 2011; 11(3):222).

Screening Methods for Endogenous Genes of Interest

The methods provided herein further allow the identification of genes of value encoding enzymes involved in the production of a component of added nutritional value or generally genes affecting agronomic traits of interest, across species, phyla, and plant kingdom. By selectively targeting e.g. genes encoding enzymes of metabolic pathways in plants using the AD-functionalized CRISPR system as described herein, the genes responsible for certain nutritional aspects of a plant can be identified. Similarly, by selectively targeting genes which may affect a desirable agronomic trait, the relevant genes can be identified. Accordingly, the present invention encompasses screening methods for genes encoding enzymes involved in the production of compounds with a particular nutritional value and/or agronomic traits.

Further Applications of the AD-Functionalized CRISPR System in Plants and Yeasts Use of AD-Functionalized CRISPR System in Biofuel Production The term "biofuel" as used herein is an alternative fuel made from plant and plant-derived resources. Renewable biofuels can be extracted from organic matter whose energy has been obtained through a process of carbon fixation or are made through the use or conversion of biomass. This biomass can be used directly for biofuels or can be converted to convenient energy containing substances by thermal conversion, chemical conversion, and biochemical conversion. This biomass conversion can result in fuel in solid, liquid, or gas form. There are two types of biofuels: bioethanol and biodiesel. Bioethanol is mainly produced by the sugar fermentation process of cellulose (starch), which is mostly derived from maize and sugar cane. Biodiesel on the other hand is mainly produced from oil crops such as rapeseed, palm, and soybean. Biofuels are used mainly for transportation.

Enhancing Plant Properties for Biofuel Production

In particular embodiments, the methods using the AD-functionalized CRISPR system as described herein are used to alter the properties of the cell wall in order to facilitate access by key hydrolysing agents for a more efficient release of sugars for fermentation. In particular embodiments, the biosynthesis of cellulose and/or lignin are modified. Cellulose is the major component of the cell wall. The biosynthesis of cellulose and lignin are co-regulated. By reducing the proportion of lignin in a plant the proportion of cellulose can be increased. In particular embodiments, the methods described herein are used to downregulate lignin biosynthesis in the plant so as to increase fermentable carbohydrates. More particularly, the methods described herein are used to downregulate at least a first lignin biosynthesis gene selected from the group consisting of 4-coumarate 3-hydroxylase (C3H), phenylalanine ammonia-lyase (PAL), cinnamate 4-hydroxylase (C4H), hydroxycinnamoyl transferase (HCT), caffeic acid O-methyltransferase (COMT), caffeoyl CoA 3-O-methyltransferase (CCoAOMT), ferulate 5-hydroxylase (F5H), cinnamyl alcohol dehydrogenase (CAD), cinnamoyl CoA-reductase (CCR), 4-coumarate-CoA ligase (4CL), monolignol-lignin-specific glycosyltransferase, and aldehyde dehydrogenase (ALDH) as disclosed in WO 2008064289 A2.

In particular embodiments, the methods described herein are used to produce plant mass that produces lower levels of acetic acid during fermentation (see also WO 2010096488). More particularly, the methods disclosed herein are used to generate mutations in homologs to CasIL to reduce polysaccharide acetylation.

Modifying Yeast for Biofuel Production

In particular embodiments, the AD-functionalized CRISPR system provided herein is used for bioethanol production by recombinant micro-organisms. For instance, the AD-functionalized CRISPR system can be used to engineer micro-organisms, such as yeast, to generate biofuel or biopolymers from fermentable sugars and optionally to be able to degrade plant-derived lignocellulose derived from agricultural waste as a source of fermentable sugars. In some embodiments, the AD-functionalized CRISPR system is used to modify endogenous metabolic pathways which compete with the biofuel production pathway.

Accordingly, in more particular embodiments, the methods described herein are used to modify a micro-organism as follows: to modify at least one nucleic acid encoding for an enzyme in a metabolic pathway in said host cell, wherein said pathway produces a metabolite other than acetaldehyde from pyruvate or ethanol from acetaldehyde, and wherein said modification results in a reduced production of said metabolite, or to introduce at least one nucleic acid encoding for an inhibitor of said enzyme.

Modifying Algae and Plants for Production of Vegetable Oils or Biofuels

Transgenic algae or other plants such as rape may be particularly useful in the production of vegetable oils or biofuels such as alcohols (especially methanol and ethanol), for instance. These may be engineered to express or overexpress high levels of oil or alcohols for use in the oil or biofuel industries.

According to particular embodiments of the invention, the AD-functionalized CRISPR system is used to generate lipid-rich diatoms which are useful in biofuel production.

In particular embodiments it is envisaged to specifically modify genes that are involved in the modification of the quantity of lipids and/or the quality of the lipids produced by the algal cell. Examples of genes encoding enzymes involved in the pathways of fatty acid synthesis can encode proteins having for instance acetyl-CoA carboxylase, fatty acid synthase, 3-ketoacyl_acyl-carrier protein synthase III, glycerol-3-phosphate deshydrogenase (G3PDH), Enoyl-acyl carrier protein reductase (Enoyl-ACP-reductase), glycerol-3-phosphate acyltransferase, lysophosphatidic acyl transferase or diacylglycerol acyltransferase, phospholipid: diacylglycerol acyltransferase, phosphatidate phosphatase, fatty acid thioesterase such as palmitoyl protein thioesterase, or malic enzyme activities. In further embodiments it is envisaged to generate diatoms that have increased lipid accumulation. This can be achieved by targeting genes that decrease lipid catabolisation. Of particular interest for use in the methods of the present invention are genes involved in the activation of both triacylglycerol and free fatty acids, as well as genes directly involved in β-oxidation of fatty acids, such as acyl-CoA synthetase, 3-ketoacyl-CoA thiolase, acyl-CoA oxidase activity and phosphoglucomutase. The AD-functionalized CRISPR system and methods described herein can be used to specifically activate such genes in diatoms as to increase their lipid content.

Organisms such as microalgae are widely used for synthetic biology. Stovicek et al. (Metab. Eng. Comm., 2015; 2:13 describes genome editing of industrial yeast, for example, *Saccharomyces cerevisiae*, to efficiently produce robust strains for industrial production. Stovicek used a CRISPR-Cas9 system codon-optimized for yeast to simultaneously disrupt both alleles of an endogenous gene and knock in a heterologous gene. Cas9 and guide RNA were expressed from genomic or episomal 2-based vector locations. The authors also showed that gene disruption efficiency could be improved by optimization of the levels of Cas9 and guide RNA expression. Hlavová et al. (Biotechnol. Adv. 2015) discusses development of species or strains of microalgae using techniques such as CRISPR to target nuclear and chloroplast genes for insertional mutagenesis and screening.

U.S. Pat. No. 8,945,839 describes a method for engineering Micro-Algae (*Chlamydomonas reinhardtii* cells) species) using Cas9. Using similar tools, the methods of the AD-functionalized CRISPR system described herein can be applied on *Chlamydomonas* species and other algae. In particular embodiments, a CRISPR-Cas protein (e.g., Cas13), adenosine deaminase (which may be fused to the CRISPR-Cas protein or an aptamer-binding adaptor protein), and guide RNA are introduced in algae expressed using a vector that expresses the CRISPR-Cas protein and optionally the adenosine deaminase under the control of a constitutive promoter such as Hsp70A-Rbc S2 or Beta2-tubulin. Guide RNA will be delivered using a vector containing T7 promoter. Alternatively, mRNA and in vitro transcribed guide RNA can be delivered to algal cells. Electroporation protocol follows standard recommended protocol from the GeneArt *Chlamydomonas* Engineering kit.

The Use of AD-Functionalized CRISPR System in the Generation of Micro-Organisms Capable of Fatty Acid Production In particular embodiments, the methods of the invention are used for the generation of genetically engineered micro-organisms capable of the production of fatty esters, such as fatty acid methyl esters ("FAME") and fatty acid ethyl esters ("FAEE"), Typically, host cells can be engineered to produce fatty esters from a carbon source, such as an alcohol, present in the medium, by expression or overexpression of a gene encoding a thioesterase, a gene encoding an acyl-CoA synthase, and a gene encoding an ester synthase. Accordingly, the methods provided herein are used to modify a micro-organisms so as to overexpress or introduce a thioesterase gene, a gene encoding an acyl-CoA synthase, and a gene encoding an ester synthase. In particular embodiments, the thioesterase gene is selected from tesA, 'tesA, tesB, fatB, fatB2, fatB3, fatA1, or fatA. In particular embodiments, the gene encoding an acyl-CoA synthase is selected from fadDJadK, BH3103, pfl-4354, EAV15023, fadD1, fadD2, RPC_4074, fadDD35, fadDD22, faa39, or an identified gene encoding an enzyme having the same properties. In particular embodiments, the gene encoding an ester synthase is a gene encoding a synthase/acyl-CoA: diacylglycerol acyltransferase from *Simmondsia chinensis, Acinetobacter* sp. ADP, *Alcanivorax borkumensis, Pseudomonas aeruginosa, Fundibacter jadensis, Arabidopsis thaliana*, or *Alcaligenes eutrophus*, or a variant thereof. Additionally or alternatively, the methods provided herein are used to decrease expression in said micro-organism of at least one of a gene encoding an acyl-CoA dehydrogenase, a gene encoding an outer membrane protein receptor, and a gene encoding a transcriptional regulator of fatty acid biosynthesis. In particular embodiments one or more of these genes is inactivated, such as by introduction of a mutation. In particular embodiments, the gene encoding an acyl-CoA dehydrogenase is fadE. In particular embodiments, the gene encoding a transcriptional regulator of fatty acid biosynthesis encodes a DNA transcription repressor, for example, fabR.

Additionally or alternatively, said micro-organism is modified to reduce expression of at least one of a gene encoding a pyruvate formate lyase, a gene encoding a lactate dehydrogenase, or both. In particular embodiments, the gene encoding a pyruvate formate lyase is pflB. In particular embodiments, the gene encoding a lactate dehydrogenase is ldhA. In particular embodiments one or more of these genes is inactivated, such as by introduction of a mutation therein.

In particular embodiments, the micro-organism is selected from the genus *Escherichia, Bacillus, Lactobacillus, Rhodococcus, Synechococcus, Synechocystis, Pseudomonas, Aspergillus, Trichoderma, Neurospora, Fusarium, Humicola, Rhizomucor, Kluyveromyces, Pichia, Mucor, Myceliophthora Penicillium, Phanerochaete, Pleurotus, Trametes, Chrysosporium, Saccharomyces, Stenotrophomonas, Schizosaccharomyces, Yarrowia*, or *Streptomyces*.

The Use of AD-Functionalized CRISPR System in the Generation of Micro-Organisms Capable of Organic Acid Production The methods provided herein are further used to engineer micro-organisms capable of organic acid production, more particularly from pentose or hexose sugars. In particular embodiments, the methods comprise introducing into a micro-organism an exogenous LDH gene. In particular embodiments, the organic acid production in said micro-organisms is additionally or alternatively increased by inactivating endogenous genes encoding proteins involved in an endogenous metabolic pathway which produces a metabolite other than the organic acid of interest and/or wherein the endogenous metabolic pathway consumes the organic acid. In particular embodiments, the modification ensures that the production of the metabolite other than the organic acid of interest is reduced. According to particular embodiments, the methods are used to introduce at least one engineered gene deletion and/or inactivation of an endogenous pathway in which the organic acid is consumed or a gene encoding a product involved in an endogenous pathway which produces a metabolite other than the organic acid of interest. In particular embodiments, the at least one engineered gene deletion or inactivation is in one or more gene encoding an enzyme selected from the group consisting of pyruvate decarboxylase (pdc), fumarate reductase, alcohol dehydrogenase (adh), acetaldehyde dehydrogenase, phosphoenolpyruvate carboxylase (ppc), D-lactate dehydrogenase (d-ldh), L-lactate dehydrogenase (l-ldh), lactate 2-monooxygenase. In further embodiments the at least one engineered gene deletion and/or inactivation is in an endogenous gene encoding pyruvate decarboxylase (pdc).

In further embodiments, the micro-organism is engineered to produce lactic acid and the at least one engineered gene deletion and/or inactivation is in an endogenous gene encoding lactate dehydrogenase. Additionally or alternatively, the micro-organism comprises at least one engineered gene deletion or inactivation of an endogenous gene encoding a cytochrome-dependent lactate dehydrogenase, such as a cytochrome B2-dependent L-lactate dehydrogenase.

The Use of AD-Functionalized CRISPR System in the Generation of Improved Xylose or Cellobiose Utilizing Yeasts Strains In particular embodiments, the AD-functionalized CRISPR system may be applied to select for improved xylose or cellobiose utilizing yeast strains. Error-prone PCR can be used to amplify one (or more) genes involved in the xylose utilization or cellobiose utilization pathways. Examples of genes involved in xylose utilization pathways and cellobiose utilization pathways may include, without limitation, those described in Ha, S. J., et al. (2011) Proc. Natl. Acad. Sci. USA 108(2):504-9 and Galazka, J. M., et al. (2010) Science 330(6000):84-6. Resulting libraries of double-stranded DNA molecules, each comprising a random mutation in such a selected gene could be co-transformed with the components of the AD-functionalized CRISPR system into a yeast strain (for instance S288C) and strains can be selected with enhanced xylose or cellobiose utilization capacity, as described in WO2015138855.

The Use of AD-Functionalized CRISPR System in the Generation of Improved Yeasts Strains for Use in Isoprenoid Biosynthesis Tadas Jakočiūnas et al. described the successful application of a multiplex CRISPR-Cas9 system for genome engineering of up to 5 different genomic loci in one transformation step in baker's yeast *Saccharomyces cerevisiae* (Metabolic Engineering Volume 28, March 2015, Pages 213-222) resulting in strains with high mevalonate production, a key intermediate for the industrially important isoprenoid biosynthesis pathway. In particular embodiments, the AD-functionalized CRISPR system may be applied in a multiplex genome engineering method as described herein for identifying additional high producing yeast strains for use in isoprenoid synthesis.

Improved Plants and Yeast Cells

The present invention also provides plants and yeast cells obtainable and obtained by the methods provided herein. The improved plants obtained by the methods described herein may be useful in food or feed production through expression of genes which, for instance ensure tolerance to plant pests, herbicides, drought, low or high temperatures, excessive water, etc.

The improved plants obtained by the methods described herein, especially crops and algae may be useful in food or feed production through expression of, for instance, higher protein, carbohydrate, nutrient or vitamin levels than would normally be seen in the wildtype. In this regard, improved plants, especially pulses and tubers are preferred.

Improved algae or other plants such as rape may be particularly useful in the production of vegetable oils or biofuels such as alcohols (especially methanol and ethanol), for instance. These may be engineered to express or overexpress high levels of oil or alcohols for use in the oil or biofuel industries.

The invention also provides for improved parts of a plant. Plant parts include, but are not limited to, leaves, stems, roots, tubers, seeds, endosperm, ovule, and pollen. Plant parts as envisaged herein may be viable, nonviable, regeneratable, and/or non-regeneratable.

It is also encompassed herein to provide plant cells and plants generated according to the methods of the invention. Gametes, seeds, embryos, either zygotic or somatic, progeny or hybrids of plants comprising the genetic modification, which are produced by traditional breeding methods, are also included within the scope of the present invention. Such plants may contain a heterologous or foreign DNA sequence inserted at or instead of a target sequence. Alternatively, such plants may contain only an alteration (mutation, deletion, insertion, substitution) in one or more nucleotides. As such, such plants will only be different from their progenitor plants by the presence of the particular modification.

Thus, the invention provides a plant, animal or cell, produced by the present methods, or a progeny thereof. The progeny may be a clone of the produced plant or animal, or may result from sexual reproduction by crossing with other individuals of the same species to introgress further desirable traits into their offspring. The cell may be in vivo or ex vivo in the cases of multicellular organisms, particularly animals or plants.

The methods for genome editing using the AD-functionalized CRISPR system as described herein can be used to confer desired traits on essentially any plant, algae, fungus, yeast, etc. A wide variety of plants, algae, fungus, yeast, etc and plant algae, fungus, yeast cell or tissue systems may be engineered for the desired physiological and agronomic characteristics described herein using the nucleic acid constructs of the present disclosure and the various transformation methods mentioned above.

In particular embodiments, the methods described herein are used to modify endogenous genes or to modify their expression without the permanent introduction into the genome of the plant, algae, fungus, yeast, etc of any foreign gene, including those encoding CRISPR components, so as to avoid the presence of foreign DNA in the genome of the plant. This can be of interest as the regulatory requirements for non-transgenic plants are less rigorous.

The methods described herein generally result in the generation of "improved plants, algae, fungi, yeast, etc" in that they have one or more desirable traits compared to the wildtype plant. In particular embodiments, non-transgenic genetically modified plants, algae, fungi, yeast, etc., parts or cells are obtained, in that no exogenous DNA sequence is incorporated into the genome of any of the cells of the plant. In such embodiments, the improved plants, algae, fungi, yeast, etc. are non-transgenic. Where only the modification of an endogenous gene is ensured and no foreign genes are introduced or maintained in the plant, algae, fungi, yeast, etc. genome, the resulting genetically modified crops contain no foreign genes and can thus basically be considered non-transgenic. The different applications of the AD-functionalized CRISPR system for plant, algae, fungi, yeast, etc. genome editing include, but are not limited to: editing of endogenous genes to confer an agricultural trait of interest. Exemplary genes conferring agronomic traits include, but are not limited to genes that confer resistance to pests or diseases; genes involved in plant diseases, such as those listed in WO 2013046247; genes that confer resistance to herbicides, fungicides, or the like; genes involved in (abiotic) stress tolerance. Other aspects of the use of the CRISPR-Cas system include, but are not limited to: create (male) sterile plants; increasing the fertility stage in plants/algae etc; generate genetic variation in a crop of interest; affect fruit-ripening; increasing storage life of plants/algae etc; reducing allergen in plants/algae etc; ensure a value added trait (e.g. nutritional improvement); Screening methods for endogenous genes of interest; biofuel, fatty acid, organic acid, etc production.

AD-Functionalized CRISPR System can be Used in Non-Human Organisms

In an aspect, the invention provides a non-human eukaryotic organism; preferably a multicellular eukaryotic organism, comprising a eukaryotic host cell according to any of the described embodiments. In other aspects, the invention provides a eukaryotic organism; preferably a multicellular eukaryotic organism, comprising a eukaryotic host cell according to any of the described embodiments. The organism in some embodiments of these aspects may be an animal; for example a mammal. Also, the organism may be an arthropod such as an insect. The present invention may also be extended to other agricultural applications such as, for example, farm and production animals. For example, pigs have many features that make them attractive as biomedical models, especially in regenerative medicine. In particular, pigs with severe combined immunodeficiency (SCID) may provide useful models for regenerative medicine, xenotransplantation (discussed also elsewhere herein), and tumor development and will aid in developing therapies for human SCID patients. Lee et al., (Proc Natl Acad Sci USA. 2014 May 20; 111(20):7260-5) utilized a reporter-guided transcription activator-like effector nuclease (TALEN) system to generated targeted modifications of recombination activating gene (RAG) 2 in somatic cells at high efficiency, including some that affected both alleles. The AD-functionalized CRISPR system may be applied to a similar system.

The methods of Lee et al., (Proc Natl Acad Sci USA. 2014 May 20; 111(20):7260-5) may be applied to the present invention analogously as follows. Mutated pigs are produced by targeted modification of RAG2 in fetal fibroblast cells followed by SCNT and embryo transfer. Constructs coding for CRISPR Cas and a reporter are electroporated into fetal-derived fibroblast cells. After 48 h, transfected cells expressing the green fluorescent protein are sorted into individual wells of a 96-well plate at an estimated dilution of a single cell per well. Targeted modification of RAG2 are screened by amplifying a genomic DNA fragment flanking any CRISPR Cas cutting sites followed by sequencing the PCR products. After screening and ensuring lack of off-site mutations, cells carrying targeted modification of RAG2 are used for SCNT. The polar body, along with a portion of the adjacent cytoplasm of oocyte, presumably containing the metaphase II plate, are removed, and a donor cell are placed in the perivitelline. The reconstructed embryos are then electrically porated to fuse the donor cell with the oocyte and then chemically activated. The activated embryos are incubated in Porcine Zygote Medium 3 (PZM3) with 0.5 µM Scriptaid (S7817; Sigma-Aldrich) for 14-16 h. Embryos are then washed to remove the Scriptaid and cultured in PZM3 until they were transferred into the oviducts of surrogate pigs.

The present invention is also applicable to modifying SNPs of other animals, such as cows. Tan et al. (Proc Natl Acad Sci USA. 2013 Oct. 8; 110(41): 16526-16531) expanded the livestock gene editing toolbox to include transcription activator-like (TAL) effector nuclease (TALEN)- and clustered regularly interspaced short palindromic repeats (CRISPR)/Cas9-stimulated homology-directed repair (HDR) using plasmid, rAAV, and oligonucleotide templates. Gene specific guide RNA sequences were cloned into the Church lab guide RNA vector (Addgene ID: 41824) according to their methods (Mali P, et al. (2013) RNA-Guided Human Genome Engineering via Cas9. Science 339(6121):823-826). The Cas9 nuclease was provided either by co-transfection of the hCas9 plasmid (Addgene ID: 41815) or mRNA synthesized from RCIScript-hCas9. This RCIScript-hCas9 was constructed by sub-cloning the XbaI- AgeI fragment from the hCas9 plasmid (encompassing the hCas9 cDNA) into the RCIScript plasmid.

Heo et al. (Stem Cells Dev. 2015 Feb. 1; 24(3):393-402. doi: 10.1089/scd.2014.0278. Epub 2014 Nov. 3) reported highly efficient gene targeting in the bovine genome using bovine pluripotent cells and clustered regularly interspaced short palindromic repeat (CRISPR)/Cas9 nuclease. First, Heo et al. generate induced pluripotent stem cells (iPSCs) from bovine somatic fibroblasts by the ectopic expression of yamanaka factors and GSK3β and MEK inhibitor (2i) treatment. Heo et al. observed that these bovine iPSCs are highly similar to naïve pluripotent stem cells with regard to gene expression and developmental potential in teratomas. Moreover, CRISPR-Cas9 nuclease, which was specific for the bovine NANOG locus, showed highly efficient editing of the bovine genome in bovine iPSCs and embryos.

Igenity® provides a profile analysis of animals, such as cows, to perform and transmit traits of economic traits of economic importance, such as carcass composition, carcass quality, maternal and reproductive traits and average daily gain. The analysis of a comprehensive Igenity® profile begins with the discovery of DNA markers (most often single nucleotide polymorphisms or SNPs). All the markers behind the Igenity® profile were discovered by independent scientists at research institutions, including universities, research organizations, and government entities such as USDA. Markers are then analyzed at Igenity® in validation populations. Igenity® uses multiple resource populations that represent various production environments and biological types, often working with industry partners from the seedstock, cow-calf, feedlot and/or packing segments of the beef industry to collect phenotypes that are not commonly available. Cattle genome databases are widely available, see, e.g., the NAGRP Cattle Genome Coordination Program (animalgenome.org/cattle/maps/db.html). Thus, the present invention maybe applied to target bovine SNPs. One of skill in the art may utilize the above protocols for targeting SNPs and apply them to bovine SNPs as described, for example, by Tan et al. or Heo et al.

Qingjian Zou et al. (Journal of Molecular Cell Biology Advance Access published Oct. 12, 2015) demonstrated increased muscle mass in dogs by targeting the first exon of the dog Myostatin (MSTN) gene (a negative regulator of skeletal muscle mass). First, the efficiency of the sgRNA was validated, using cotransfection of the sgRNA targeting MSTN with a Cas9 vector into canine embryonic fibroblasts (CEFs). Thereafter, MSTN KO dogs were generated by micro-injecting embryos with normal morphology with a mixture of Cas9 mRNA and MSTN sgRNA and auto-transplantation of the zygotes into the oviduct of the same female dog. The knock-out puppies displayed an obvious muscular phenotype on thighs compared with its wild-type littermate sister. This can also be performed using the AD-functionalized CRISPR systems provided herein.

Livestock—Pigs

Viral targets in livestock may include, in some embodiments, porcine CD163, for example on porcine macrophages. CD163 is associated with infection (thought to be through viral cell entry) by PRRSv (Porcine Reproductive and Respiratory Syndrome virus, an arterivirus). Infection by PRRSv, especially of porcine alveolar macrophages (found in the lung), results in a previously incurable porcine syndrome ("Mystery swine disease" or "blue ear disease") that causes suffering, including reproductive failure, weight loss and high mortality rates in domestic pigs. Opportunistic infections, such as enzootic pneumonia, meningitis and ear oedema, are often seen due to immune deficiency through loss of macrophage activity. It also has significant economic and environmental repercussions due to increased antibiotic use and financial loss (an estimated $660m per year).

As reported by Kristin M Whitworth and Dr Randall Prather et al. (Nature Biotech 3434 published online 7 Dec. 2015) at the University of Missouri and in collaboration with Genus Plc, CD163 was targeted using CRISPR-Cas9 and the offspring of edited pigs were resistant when exposed to PRRSv. One founder male and one founder female, both of whom had mutations in exon 7 of CD163, were bred to produce offspring. The founder male possessed an 11-bp deletion in exon 7 on one allele, which results in a frameshift mutation and missense translation at amino acid 45 in domain 5 and a subsequent premature stop codon at amino acid 64. The other allele had a 2-bp addition in exon 7 and a 377-bp deletion in the preceding intron, which were predicted to result in the expression of the first 49 amino acids of domain 5, followed by a premature stop code at amino acid 85. The sow had a 7 bp addition in one allele that when translated was predicted to express the first 48 amino acids of domain 5, followed by a premature stop codon at amino acid 70. The sow's other allele was unamplifiable. Selected offspring were predicted to be a null animal (CD163−/−), i.e. a CD163 knock out.

Accordingly, in some embodiments, porcine alveolar macrophages may be targeted by the CRISPR protein. In some embodiments, porcine CD163 may be targeted by the CRISPR protein. In some embodiments, porcine CD163 may be knocked out through induction of a DSB or through insertions or deletions, for example targeting deletion or modification of exon 7, including one or more of those described above, or in other regions of the gene, for example deletion or modification of exon 5.

An edited pig and its progeny are also envisaged, for example a CD163 knock out pig. This may be for livestock, breeding or modelling purposes (i.e. a porcine model). Semen comprising the gene knock out is also provided.

CD163 is a member of the scavenger receptor cysteine-rich (SRCR) superfamily. Based on in vitro studies SRCR domain 5 of the protein is the domain responsible for unpackaging and release of the viral genome. As such, other members of the SRCR superfamily may also be targeted in order to assess resistance to other viruses. PRRSV is also a member of the mammalian arterivirus group, which also includes murine lactate dehydrogenase-elevating virus, simian hemorrhagic fever virus and equine arteritis virus. The arteriviruses share important pathogenesis properties, including macrophage tropism and the capacity to cause both severe disease and persistent infection. Accordingly, arteriviruses, and in particular murine lactate dehydrogenase-elevating virus, simian hemorrhagic fever virus and equine arteritis virus, may be targeted, for example through porcine CD163 or homologues thereof in other species, and murine, simian and equine models and knockout also provided.

Indeed, this approach may be extended to viruses or bacteria that cause other livestock diseases that may be transmitted to humans, such as Swine Influenza Virus (SIV) strains which include influenza C and the subtypes of influenza A known as H1N1, H1N2, H2N1, H3N1, H3N2, and H2N3, as well as pneumonia, meningitis and oedema mentioned above.

In some embodiments, the AD-functionalized CRISPR system described herein can be used to genetically modify a pig genome to inactivate one or more porcine endogenous retrovirus (PERVs) loci to facilitate clinical application of porcine-to-human xenotransplantation. See Yang et al., Science 350(6264):1101-1104 (2015), which is incorporated herein by reference in its entirety. In some embodiments, the AD-functionalized CRISPR system described herein can be used to produce a genetically modified pig that does not comprise any active porcine endogenous retrovirus (PERVs) locus.

Therapeutic Targeting with AD-Functionalized CRISPR System

As will be apparent, it is envisaged that AD-functionalized CRISPR system can be used to target any polynucleotide sequence of interest. The invention provides a non-naturally occurring or engineered composition, or one or more polynucleotides encoding components of said composition, or vector or delivery systems comprising one or more polynucleotides encoding components of said composition for use in a modifying a target cell in vivo, ex vivo or in vitro and, may be conducted in a manner alters the cell such that once modified the progeny or cell line of the CRISPR modified cell retains the altered phenotype. The modified cells and progeny may be part of a multi-cellular organism such as a plant or animal with ex vivo or in vivo application of CRISPR system to desired cell types. The CRISPR invention may be a therapeutic method of treatment. The therapeutic method of treatment may comprise gene or genome editing, or gene therapy.

Adoptive Cell Therapies

The present invention also contemplates use of the AD-functionalized CRISPR system described herein to modify cells for adoptive therapies. Aspects of the invention accordingly involve the adoptive transfer of immune system cells, such as T cells, specific for selected antigens, such as tumor associated antigens (see Maus et al., 2014, Adoptive Immunotherapy for Cancer or Viruses, Annual Review of Immunology, Vol. 32: 189-225; Rosenberg and Restifo, 2015, Adoptive cell transfer as personalized immunotherapy for human cancer, Science Vol. 348 no. 6230 pp. 62-68; and, Restifo et al., 2015, Adoptive immunotherapy for cancer: harnessing the T cell response. Nat. Rev. Immunol. 12(4): 269-281; and Jenson and Riddell, 2014, Design and implementation of adoptive therapy with chimeric antigen receptor-modified T cells. Immunol Rev. 257(1): 127-144). Various strategies may for example be employed to genetically modify T cells by altering the specificity of the T cell receptor (TCR) for example by introducing new TCR α and β chains with selected peptide specificity (see U.S. Pat. No. 8,697,854; PCT Patent Publications: WO2003020763, WO2004033685, WO2004044004, WO2005114215, WO2006000830, WO2008038002, WO2008039818, WO2004074322, WO2005113595, WO2006125962, WO2013166321, WO2013039889, WO2014018863, WO2014083173; U.S. Pat. No. 8,088,379).

As an alternative to, or addition to, TCR modifications, chimeric antigen receptors (CARs) may be used in order to generate immunoresponsive cells, such as T cells, specific for selected targets, such as malignant cells, with a wide variety of receptor chimera constructs having been described (see U.S. Pat. Nos. 5,843,728; 5,851,828; 5,912,170; 6,004,811; 6,284,240; 6,392,013; 6,410,014; 6,753,162; 8,211,422; and, PCT Publication WO9215322). Alternative CAR constructs may be characterized as belonging to successive generations. First-generation CARs typically consist of a single-chain variable fragment of an antibody specific for an antigen, for example comprising a VL linked to a VH of a specific antibody, linked by a flexible linker, for example by a CD8α hinge domain and a CD8α transmembrane domain, to the transmembrane and intracellular signaling domains of either CD3ζ or FcRγ (scFv-CD3ζ or scFv-FcRγ; see U.S. Pat. Nos. 7,741,465; 5,912,172; 5,906,936). Second-generation CARs incorporate the intracellular domains of one or more costimulatory molecules, such as CD28, OX40 (CD134), or 4-1BB (CD137) within the endodomain (for example scFv-CD28/OX40/4-1BB-CD3ζ; see U.S. Pat. Nos. 8,911,993; 8,916,381; 8,975,071; 9,101,584; 9,102,760; 9,102,761). Third-generation CARs include a combination of costimulatory endodomains, such a CD3ζ-chain, CD97, GDI 1a-CD18, CD2, ICOS, CD27, CD154, CDS, OX40, 4-1BB, or CD28 signaling domains (for example scFv-CD28-4-1BB-CD3ζ or scFv-CD28-OX40-CD3ζ; see U.S. Pat. Nos. 8,906,682; 8,399,645; 5,686,281; PCT Publication No. WO2014134165; PCT Publication No. WO2012079000). Alternatively, costimulation may be orchestrated by expressing CARs in antigen-specific T cells, chosen so as to be activated and expanded following engagement of their native aPTCR, for example by antigen on professional antigen-presenting cells, with attendant costimulation. In addition, additional engineered receptors may be provided on the immunoresponsive cells, for example to improve targeting of a T-cell attack and/or minimize side effects.

Alternative techniques may be used to transform target immunoresponsive cells, such as protoplast fusion, lipofection, transfection or electroporation. A wide variety of vectors may be used, such as retroviral vectors, lentiviral vectors, adenoviral vectors, adeno-associated viral vectors, plasmids or transposons, such as a Sleeping Beauty transposon (see U.S. Pat. Nos. 6,489,458; 7,148,203; 7,160,682; 7,985,739; 8,227,432), may be used to introduce CARs, for example using 2nd generation antigen-specific CARs signaling through CD3ζ and either CD28 or CD137. Viral vectors may for example include vectors based on HIV, SV40, EBV, HSV or BPV.

Cells that are targeted for transformation may for example include T cells, Natural Killer (NK) cells, cytotoxic T lymphocytes (CTL), regulatory T cells, human embryonic stem cells, tumor-infiltrating lymphocytes (TIL) or a pluripotent stem cell from which lymphoid cells may be differentiated. T cells expressing a desired CAR may for example be selected through co-culture with γ-irradiated activating and propagating cells (AaPC), which co-express the cancer antigen and co-stimulatory molecules. The engineered CAR T-cells may be expanded, for example by co-culture on AaPC in presence of soluble factors, such as IL-2 and IL-21. This expansion may for example be carried out so as to provide memory CAR+ T cells (which may for example be assayed by non-enzymatic digital array and/or multi-panel flow cytometry). In this way, CAR T cells may be provided that have specific cytotoxic activity against antigen-bearing tumors (optionally in conjunction with production of desired chemokines such as interferon-γ). CAR T cells of this kind may for example be used in animal models, for example to threat tumor xenografts.

Approaches such as the foregoing may be adapted to provide methods of treating and/or increasing survival of a subject having a disease, such as a neoplasia, for example by administering an effective amount of an immunoresponsive cell comprising an antigen recognizing receptor that binds a selected antigen, wherein the binding activates the immunoresponsive cell, thereby treating or preventing the disease (such as a neoplasia, a pathogen infection, an autoimmune disorder, or an allogeneic transplant reaction). Dosing in CAR T cell therapies may for example involve administration of from 106 to 109 cells/kg, with or without a course of lymphodepletion, for example with cyclophosphamide.

In one embodiment, the treatment can be administrated into patients undergoing an immunosuppressive treatment. The cells or population of cells, may be made resistant to at least one immunosuppressive agent due to the inactivation of a gene encoding a receptor for such immunosuppressive agent. Not being bound by a theory, the immunosuppressive treatment should help the selection and expansion of the immunoresponsive or T cells according to the invention within the patient.

The administration of the cells or population of cells according to the present invention may be carried out in any convenient manner, including by aerosol inhalation, injection, ingestion, transfusion, implantation or transplantation. The cells or population of cells may be administered to a patient subcutaneously, intradermally, intratumorally, intranodally, intramedullary, intramuscularly, by intravenous or intralymphatic injection, or intraperitoneally. In one embodiment, the cell compositions of the present invention are preferably administered by intravenous injection.

The administration of the cells or population of cells can consist of the administration of $10^4$-$10^9$ cells per kg body weight, preferably $10^5$ to $10^6$ cells/kg body weight including all integer values of cell numbers within those ranges. Dosing in CAR T cell therapies may for example involve administration of from $10^6$ to $10^9$ cells/kg, with or without a course of lymphodepletion, for example with cyclophosphamide. The cells or population of cells can be administrated in one or more doses. In another embodiment, the effective amount of cells are administrated as a single dose. In another embodiment, the effective amount of cells are administrated as more than one dose over a period time. Timing of administration is within the judgment of managing physician and depends on the clinical condition of the patient. The cells or population of cells may be obtained from any source, such as a blood bank or a donor. While individual needs vary, determination of optimal ranges of effective amounts of a given cell type for a particular disease or conditions are within the skill of one in the art. An effective amount means an amount which provides a therapeutic or prophylactic benefit. The dosage administrated will be dependent upon the age, health and weight of the recipient, kind of concurrent treatment, if any, frequency of treatment and the nature of the effect desired.

In another embodiment, the effective amount of cells or composition comprising those cells are administrated parenterally. The administration can be an intravenous administration. The administration can be directly done by injection within a tumor.

To guard against possible adverse reactions, engineered immunoresponsive cells may be equipped with a transgenic safety switch, in the form of a transgene that renders the cells vulnerable to exposure to a specific signal. For example, the herpes simplex viral thymidine kinase (TK) gene may be used in this way, for example by introduction into allogeneic T lymphocytes used as donor lymphocyte infusions following stem cell transplantation (Greco, et al., Improving the safety of cell therapy with the TK-suicide gene. Front. Pharmacol. 2015; 6: 95). In such cells, administration of a nucleoside prodrug such as ganciclovir or acyclovir causes cell death. Alternative safety switch constructs include inducible caspase 9, for example triggered by administration of a small-molecule dimerizer that brings together two nonfunctional icasp9 molecules to form the active enzyme. A wide variety of alternative approaches to implementing cellular proliferation controls have been described (see U.S. Patent Publication No. 20130071414; PCT Patent Publication WO2011146862; PCT Patent Publication WO2014011987; PCT Patent Publication WO2013040371; Zhou et al. BLOOD, 2014, 123/25:3895-3905; Di Stasi et al., The New England Journal of Medicine 2011; 365:1673-1683; Sadelain M, The New England Journal of Medicine 2011; 365:1735-173; Ramos et al., Stem Cells 28(6):1107-15 (2010)).

In a further refinement of adoptive therapies, genome editing with a AD-functionalized CRISPR-Cas system as described herein may be used to tailor immunoresponsive cells to alternative implementations, for example providing edited CAR T cells (see Poirot et al., 2015, Multiplex genome edited T-cell manufacturing platform for "off-the-shelf" adoptive T-cell immunotherapies, Cancer Res 75 (18): 3853). For example, immunoresponsive cells may be edited to delete expression of some or all of the class of HLA type II and/or type I molecules, or to knockout selected genes that may inhibit the desired immune response, such as the PD1 gene.

Cells may be edited using a AD-functionalized CRISPR system as described herein. AD-functionalized CRISPR systems may be delivered to an immune cell by any method described herein. In preferred embodiments, cells are edited ex vivo and transferred to a subject in need thereof. Immunoresponsive cells, CAR-T cells or any cells used for adoptive cell transfer may be edited. Editing may be performed to eliminate potential alloreactive T-cell receptors (TCR), disrupt the target of a chemotherapeutic agent, block an immune checkpoint, activate a T cell, and/or increase the differentiation and/or proliferation of functionally exhausted or dysfunctional CD8+ T-cells (see PCT Patent Publications: WO2013176915, WO2014059173, WO2014172606, WO2014184744, and WO2014191128). Editing may result in inactivation of a gene.

T cell receptors (TCR) are cell surface receptors that participate in the activation of T cells in response to the presentation of antigen. The TCR is generally made from two chains, α and β, which assemble to form a heterodimer and associates with the CD3-transducing subunits to form the T cell receptor complex present on the cell surface. Each α and β chain of the TCR consists of an immunoglobulin-like N-terminal variable (V) and constant (C) region, a hydrophobic transmembrane domain, and a short cytoplasmic region. As for immunoglobulin molecules, the variable region of the α and β chains are generated by V(D)J recombination, creating a large diversity of antigen specificities within the population of T cells. However, in contrast to immunoglobulins that recognize intact antigen, T cells are activated by processed peptide fragments in association with an MHC molecule, introducing an extra dimension to antigen recognition by T cells, known as MHC restriction. Recognition of MHC disparities between the donor and recipient through the T cell receptor leads to T cell proliferation and the potential development of graft versus host disease (GVHD). The inactivation of TCRα or TCRβ can result in the elimination of the TCR from the surface of T cells preventing recognition of alloantigen and thus GVHD. However, TCR disruption generally results in the elimination of the CD3 signaling component and alters the means of further T cell expansion.

Allogeneic cells are rapidly rejected by the host immune system. It has been demonstrated that, allogeneic leukocytes present in non-irradiated blood products will persist for no more than 5 to 6 days (Boni, Muranski et al. 2008 Blood 1; 112(12):4746-54). Thus, to prevent rejection of allogeneic cells, the host's immune system usually has to be suppressed to some extent. However, in the case of adoptive cell transfer the use of immunosuppressive drugs also have a detrimental effect on the introduced therapeutic T cells. Therefore, to effectively use an adoptive immunotherapy approach in these conditions, the introduced cells would need to be resistant to the immunosuppressive treatment. Thus, in a particular embodiment, the present invention further comprises a step of modifying T cells to make them resistant to an immunosuppressive agent, preferably by inactivating at least one gene encoding a target for an immunosuppressive agent. An immunosuppressive agent is an agent that suppresses immune function by one of several mechanisms of action. An immunosuppressive agent can be, but is not limited to a calcineurin inhibitor, a target of rapamycin, an interleukin-2 receptor α-chain blocker, an inhibitor of inosine monophosphate dehydrogenase, an inhibitor of dihydrofolic acid reductase, a corticosteroid or an immunosuppressive antimetabolite. The present invention allows conferring immunosuppressive resistance to T cells for immunotherapy by inactivating the target of the immunosuppressive agent in T cells. As non-limiting examples, targets for an immunosuppressive agent can be a receptor for an immunosuppressive agent such as: CD52, glucocorticoid receptor (GR), a FKBP family gene member and a cyclophilin family gene member.

Immune checkpoints are inhibitory pathways that slow down or stop immune reactions and prevent excessive tissue damage from uncontrolled activity of immune cells. In certain embodiments, the immune checkpoint targeted is the programmed death-1 (PD-1 or CD279) gene (PDCD1). In other embodiments, the immune checkpoint targeted is cytotoxic T-lymphocyte-associated antigen (CTLA-4). In additional embodiments, the immune checkpoint targeted is another member of the CD28 and CTLA4 Ig superfamily such as BTLA, LAG3, ICOS, PDL1 or KIR. In further additional embodiments, the immune checkpoint targeted is a member of the TNFR superfamily such as CD40, OX40, CD137, GITR, CD27 or TIM-3.

Additional immune checkpoints include Src homology 2 domain-containing protein tyrosine phosphatase 1 (SHP-1) (Watson H A, et al., SHP-1: the next checkpoint target for cancer immunotherapy? Biochem Soc Trans. 2016 Apr. 15; 44(2):356-62). SHP-1 is a widely expressed inhibitory protein tyrosine phosphatase (PTP). In T-cells, it is a negative regulator of antigen-dependent activation and proliferation. It is a cytosolic protein, and therefore not amenable to antibody-mediated therapies, but its role in activation and proliferation makes it an attractive target for genetic manipulation in adoptive transfer strategies, such as chimeric antigen receptor (CAR) T cells. Immune checkpoints may also include T cell immunoreceptor with Ig and ITIM domains (TIGIT/Vstm3/WUCAM/VSIG9) and VISTA (Le Mercier I, et al., (2015) Beyond CTLA-4 and PD-1, the generation Z of negative checkpoint regulators. Front. Immunol. 6:418).

WO2014172606 relates to the use of MT1 and/or MT1 inhibitors to increase proliferation and/or activity of exhausted CD8+ T-cells and to decrease CD8+ T-cell exhaustion (e.g., decrease functionally exhausted or unresponsive CD8+ immune cells). In certain embodiments, metallothioneins are targeted by gene editing in adoptively transferred T cells.

In certain embodiments, targets of gene editing may be at least one targeted locus involved in the expression of an immune checkpoint protein. Such targets may include, but are not limited to CTLA4, PPP2CA, PPP2CB, PTPN6, PTPN22, PDCD1, ICOS (CD278), PDL1, KIR, LAG3, HAVCR2, BTLA, CD160, TIGIT, CD96, CRTAM, LAIR1, SIGLEC7, SIGLEC9, CD244 (2B4), TNFRSF10B, TNFRSF10A, CASP8, CASP10, CASP3, CASP6, CASP7, FADD, FAS, TGFBRII, TGFBRI, SMAD2, SMAD3, SMAD4, SMAD10, SKI, SKIL, TGIF1, IL10RA, IL10RB, HMOX2, IL6R, IL6ST, EIF2AK4, CSK, PAG1, SIT1, FOXP3, PRDM1, BATF, VISTA, GUCY1A2, GUCY1A3, GUCY1B2, GUCY1B3, MT1, MT2, CD40, OX40, CD137, GITR, CD27, SIP-1 or TIM-3. In preferred embodiments, the gene locus involved in the expression of PD-1 or CTLA-4 genes is targeted. In other preferred embodiments, combinations of genes are targeted, such as but not limited to PD-1 and TIGIT.

In other embodiments, at least two genes are edited. Pairs of genes may include, but are not limited to PD1 and TCRα, PD1 and TCRβ, CTLA-4 and TCRα, CTLA-4 and TCRβ, LAG3 and TCRα, LAG3 and TCRβ, Tim3 and TCRα, Tim3 and TCRβ, BTLA and TCRα, BTLA and TCRβ, BY55 and TCRα, BY55 and TCRβ, TIGIT and TCRα, TIGIT and TCRβ, B7H5 and TCRα, B7H5 and TCRβ, LAIR1 and TCRα, LAIR1 and TCRβ, SIGLEC10 and TCRα, SIGLEC10 and TCRβ, 2B4 and TCRα, 2B4 and TCRβ.

Whether prior to or after genetic modification of the T cells, the T cells can be activated and expanded generally using methods as described, for example, in U.S. Pat. Nos. 6,352,694; 6,534,055; 6,905,680; 5,858,358; 6,887,466; 6,905,681; 7,144,575; 7,232,566; 7,175,843; 5,883,223; 6,905,874; 6,797,514; 6,867,041; and 7,572,631. T cells can be expanded in vitro or in vivo.

The practice of the present invention employs techniques known in the field of immunology, biochemistry, chemistry, molecular biology, microbiology, cell biology, genomics and recombinant DNA, which are within the skill of the art. See MOLECULAR CLONING: A LABORATORY MANUAL, 2nd edition (1989) (Sambrook, Fritsch and Maniatis); MOLECULAR CLONING: A LABORATORY MANUAL, 4th edition (2012) (Green and Sambrook); CURRENT PROTOCOLS IN MOLECULAR BIOLOGY (1987) (F. M. Ausubel, et al. eds.); the series METHODS IN ENZYMOLOGY (Academic Press, Inc.); PCR 2: A PRACTICAL APPROACH (1995) (M. J. MacPherson, B. D. Hames and G. R. Taylor eds.); ANTIBODIES, A LABORATORY MANUAL (1988) (Harlow and Lane, eds.); ANTIBODIES A LABORATORY MANUAL, 2nd edition (2013) (E. A. Greenfield ed.); and ANIMAL CELL CULTURE (1987) (R. I. Freshney, ed.).

Correction of Disease-Associated Mutations and Pathogenic SNPs

In one aspect, the invention described herein provides methods for modifying an adenosine residue at a target locus with the aim of remedying and/or preventing a diseased condition that is or is likely to be caused by a G-to-A or C-to-T point mutation or a pathogenic single nucleotide polymorphism (SNP).

Diseases Affecting the Brain and Central Nervous System

Pathogenic G-to-A or C-to-T mutations/SNPs associated with various diseases affecting the brain and central nervous system are reported in the ClinVar database and disclosed in Table A, including but not limited to Alzheimer's Disease, Parkinson's Disease, Autism, Amyotrophic lateral sclerosis (ALS), Schizophrenia, Adrenoleukodystrophy, Aicardi Goutieres syndrome, Fabry disease, Lesch-Nyhan syndrome, and Menkes Disease. Accordingly, an aspect of the invention relates to a method for correcting one or more pathogenic G-to-A or C-to-T mutations/SNPs associated with any of these diseases, as discussed below.

Alzheimer's Disease

In some embodiments, the methods, systems, and compositions described herein are used to correct one or more pathogenic G-to-A or C-to-T mutations/SNPs associated with Alzheimer's Disease. In some embodiments, the pathogenic mutations/SNPs are present in at least one gene selected from PSEN1, PSEN2, and APP, including at least the followings:

NM_000021.3(PSEN1):c.796G>A (p.Gly266Ser)
NM_000484.3(APP):c.2017G>A (p.Ala673Thr)
NM_000484.3(APP):c.2149G>A (p.Val717Ile)
NM_000484.3(APP):c.2137G>A (p.Ala713Thr)
NM_000484.3(APP):c.2143G>A (p.Val715Met)
NM_000484.3(APP):c.2141C>T (p.Thr714Ile)
NM_000021.3(PSEN1):c.438G>A (p.Met146Ile)
NM_000021.3(PSEN1):c.1229G>A (p.Cys410Tyr)
NM_000021.3(PSEN1):c.487C>T (p.His163Tyr)
NM_000021.3(PSEN1):c.799C>T (p.Pro267Ser)
NM_000021.3(PSEN1):c.236C>T (p.Ala79Val)
NM_000021.3(PSEN1):c.509C>T (p.Ser170Phe)
NM_000447.2(PSEN2):c.1289C>T (p.Thr430Met)
NM_000447.2(PSEN2):c.717G>A (p.Met239Ile)
NM_000447.2(PSEN2):c.254C>T (p.Ala85Val)
NM_000021.3(PSEN1):c.806G>A (p.Arg269His)
NM_000484.3(APP):c.2018C>T (p.Ala673Val).

See Table A. Accordingly, an aspect of the invention relates to a method for treating or preventing Alzheimer's Disease by correcting one or more pathogenic G-to-A or C-to-T mutations/SNPs, particularly one or more pathogenic G-to-A or C-to-T mutations/SNPs present in at least one gene selected from PSEN1, PSEN2, and APP, and more particularly one or more pathogenic G-to-A or C-to-T mutations/SNPs described above.

Parkinson's Disease

In some embodiments, the methods, systems, and compositions described herein are used to correct one or more pathogenic G-to-A or C-to-T mutations/SNPs associated with Parkinson's Disease. In some embodiments, In some embodiment, the pathogenic mutations/SNPs are present in at least one gene selected from SNCA, PLA2G6, FBXO7, VPS35, EIF4G1, DNAJC6, PRKN, SYNJ1, CHCHD2, PINK1, PARK7, LRRK2, ATP13A2, and GBA, including at least the followings:

NM_000345.3(SNCA):c.157G>A (p.Ala53Thr)
NM_000345.3(SNCA):c.152G>A (p.Gly51Asp)
NM_003560.3(PLA2G6):c.2222G>A (p.Arg741Gln)
NM_003560.3(PLA2G6):c.2239C>T (p.Arg747Trp)
NM_003560.3(PLA2G6):c.1904G>A (p.Arg635Gln)
NM_003560.3(PLA2G6):c.1354C>T (p.Gln452Ter)
NM_012179.3(FBXO7):c.1492C>T (p.Arg498Ter)
NM_012179.3(FBXO7):c.65C>T (p.Thr22Met)
NM_018206.5(VPS35):c.1858G>A (p.Asp620Asn)
NM_198241.2(EIF4G1):c.3614G>A (p.Arg1205His)
NM_198241.2(EIF4G1):c.1505C>T (p.Ala502Val)
NM_001256865.1(DNAJC6):c.2200C>T (p.Gln734Ter)
NM_001256865.1(DNAJC6):c.2326C>T (p.Gln776Ter)
NM_004562.2(PRKN):c.931C>T (p.Gln311Ter)
NM_004562.2(PRKN):c.1358G>A (p.Trp453Ter)
NM_004562.2(PRKN):c.635G>A (p.Cys212Tyr)
NM_203446.2(SYNJ1):c.773G>A (p.Arg258Gln)
NM_001320327.1(CHCHD2):c.182C>T (p.Thr61Ile)
NM_001320327.1(CHCHD2):c.434G>A (p.Arg145Gln)
NM_001320327.1(CHCHD2):c.300+5G>A
NM_032409.2(PINK1):c.926G>A (p.Gly309Asp)
NM_032409.2(PINK1):c.1311G>A (p.Trp437Ter)
NM_032409.2(PINK1):c.736C>T (p.Arg246Ter)
NM_032409.2(PINK1):c.836G>A (p.Arg279His)
NM_032409.2(PINK1):c.938C>T (p.Thr313Met)
NM_032409.2(PINK1):c.1366C>T (p.Gln456Ter)
NM_007262.4(PARK7):c.78G>A (p.Met26Ile)
NM_198578.3(LRRK2):c.4321C>T (p.Arg1441Cys)
NM_198578.3(LRRK2):c.4322G>A (p.Arg1441His)
NM_198578.3(LRRK2):c.1256C>T (p.Ala419Val)
NM_198578.3(LRRK2):c.6055G>A (p.Gly2019Ser)
NM_022089.3(ATP13A2):c.1306+5G>A
NM_022089.3(ATP13A2):c.2629G>A (p.Gly877Arg)
NM_022089.3(ATP13A2):c.490C>T (p.Arg164Trp)
NM_001005741.2(GBA):c.1444G>A (p.Asp482Asn)
m.15950G>A.

See Table A. Accordingly, an aspect of the invention relates to a method for treating or preventing Parkinson's Disease by correcting one or more pathogenic G-to-A or C-to-T mutations/SNPs, particularly one or more pathogenic G-to-A or C-to-T mutations/SNPs in at least one gene selected from SNCA, PLA2G6, FBXO7, VPS35, EIF4G1, DNAJC6, PRKN, SYNJ1, CHCHD2, PINK1, PARK7, LRRK2, ATP13A2, and GBA, and more particularly one or more pathogenic G-to-A or C-to-T mutations/SNPs described above.

Autism

In some embodiments, the methods, systems, and compositions described herein are used to correct one or more pathogenic G-to-A or C-to-T mutations/SNPs associated with Autism. In some embodiments, the pathogenic mutations/SNPs are present in at least one gene selected from MECP2, NLGN3, SLC9A9, EHMT1, CHD8, NLGN4X, GSPT2, and PTEN, including at least the followings:

NM_001110792.1(MECP2):c.916C>T (p.Arg306Ter)
NM_004992.3(MECP2):c.473C>T (p.Thr158Met)
NM_018977.3(NLGN3):c.1351C>T (p.Arg451Cys)
NM_173653.3(SLC9A9):c.1267C>T (p.Arg423Ter)
NM_024757.4(EHMT1):c.3413G>A (p.Trp1138Ter)
NM_020920.3(CHD8):c.2875C>T (p.Gln959Ter)
NM_020920.3(CHD8):c.3172C>T (p.Arg1058Ter)
NM_181332.2(NLGN4X):c.301C>T (p.Arg101Ter)
NM_018094.4(GSPT2):c.1021G>A (p.Val341Ile)
NM_000314.6(PTEN):c.392C>T (p.Thr131Ile)

See Table A. Accordingly, an aspect of the invention relates to a method for treating or preventing Autism by correcting one or more pathogenic G-to-A or C-to-T mutations/SNPs, particularly one or more pathogenic G-to-A or C-to-T mutations/SNPs present in at least one gene selected from MECP2, NLGN3, SLC9A9, EHMT1, CHD8, NLGN4X, GSPT2, and PTEN, and more particularly one or more pathogenic G-to-A or C-to-T mutations/SNPs described above.

Amyotrophic Lateral Sclerosis (ALS)

In some embodiments, the methods, systems, and compositions described herein are used to correct one or more pathogenic G-to-A or C-to-T mutations/SNPs associated with ALS. In some embodiments, the pathogenic mutations/SNPs are present in at least one gene selected from SOD1, VCP, UBQLN2, ERBB4, HNRNPA1, TUBA4A, SOD1, TARDBP, FIG. 4, OPTN, SETX, SPG11, FUS, VAPB, ANG, CHCHD10, SQSTM1, and TBK1, including at least the followings:

NM_000454.4(SOD1):c.289G>A (p.Asp97Asn)
NM_007126.3(VCP):c.1774G>A (p.Asp592Asn)
NM_007126.3(VCP):c.464G>A (p.Arg155His)
NM_007126.3(VCP):c.572G>A (p.Arg191Gln)
NM_013444.3(UBQLN2):c.1489C>T (p.Pro497Ser)
NM_013444.3(UBQLN2):c.1525C>T (p.Pro509Ser)
NM_013444.3(UBQLN2):c.1573C>T (p.Pro525Ser)
NM_013444.3(UBQLN2):c.1490C>T (p.Pro497Leu)
NM_005235.2(ERBB4):c.2780G>A (p.Arg927Gln)
NM_005235.2(ERBB4):c.3823C>T (p.Arg1275Trp)
NM_031157.3(HNRNPA1):c.940G>A (p.Asp314Asn)

NM_006000.2(TUBA4A):c.643C>T (p.Arg215Cys)
NM_006000.2(TUBA4A):c.958C>T (p.Arg320Cys)
NM_006000.2(TUBA4A):c.959G>A (p.Arg320His)
NM_006000.2(TUBA4A):c.1220G>A (p.Trp407Ter)
NM_006000.2(TUBA4A):c.1147G>A (p.Ala383Thr)
NM_000454.4(SOD1):c.112G>A (p.Gly38Arg)
NM_000454.4(SOD1):c.124G>A (p.Gly42Ser)
NM_000454.4(SOD1):c.125G>A (p.Gly42Asp)
NM_000454.4(SOD1):c.14C>T (p.Ala5Val)
NM_000454.4(SOD1):c.13G>A (p.Ala5Thr)
NM_000454.4(SOD1):c.436G>A (p.Ala146Thr)
NM_000454.4(SOD1):c.64G>A (p.Glu22Lys)
NM_000454.4(SOD1):c.404G>A (p.Ser135Asn)
NM_000454.4(SOD1):c.49G>A (p.Gly17Ser)
NM_000454.4(SOD1):c.217G>A (p.Gly73Ser)
NM_007375.3(TARDBP):c.892G>A (p.Gly298Ser)
NM_007375.3(TARDBP):c.943G>A (p.Ala315Thr)
NM_007375.3(TARDBP):c.883G>A (p.Gly295Ser)
NM_007375.3(TARDBP):c.*697G>A
NM_007375.3(TARDBP):c.1144G>A (p.Ala382Thr)
NM_007375.3(TARDBP):c.859G>A (p.Gly287Ser)
NM_014845.5(FIG. 4):c.547C>T (p.Arg183Ter)
NM_001008211.1(OPTN):c.1192C>T (p.Gln398Ter)
NM_015046.5(SETX):c.6407G>A (p.Arg2136His)
NM_015046.5(SETX):c.8C>T (p.Thr3Ile)
NM_025137.3(SPG11):c.118C>T (p.Gln40Ter)
NM_025137.3(SPG11):c.267G>A (p.Trp89Ter)
NM_025137.3(SPG11):c.5974C>T (p.Arg1992Ter)
NM_004960.3(FUS):c.1553G>A (p.Arg518Lys)
NM_004960.3(FUS):c.1561C>T (p.Arg521Cys)
NM_004960.3(FUS):c.1562G>A (p.Arg521His)
NM_004960.3(FUS):c.1520G>A (p.Gly507Asp)
NM_004960.3(FUS):c.1483C>T (p.Arg495Ter)
NM_004960.3(FUS):c.616G>A (p.Gly206Ser)
NM_004960.3(FUS):c.646C>T (p.Arg216Cys)
NM_004738.4(VAPB):c.166C>T (p.Pro56Ser)
NM_004738.4(VAPB):c.137C>T (p.Thr46Ile)
NM_001145.4(ANG):c.164G>A (p.Arg55Lys)
NM_001145.4(ANG):c.155G>A (p.Ser52Asn)
NM_001 145.4(ANG): c.407C>T (p.Pro136Leu)
NM_001 145.4(ANG):c.409G>A (p.Val137Ile)
NM_001301339.1(CHCHD10):c.239C>T (p.Pro80Leu)
NM_001301339.1(CHCHD10):c.176C>T (p.Ser59Leu)
NM_001142298.1(SQSTM1):c.-47-1924C>T
NM_003900.4(SQSTM1):c. 1160C>T (p.Pro387Leu)
NM_003900.4(SQSTM1):c. 1175C>T (p.Pro392Leu)
NM_013254.3(TBK1):c.1340+1G>A
NM_013254.3(TBK1):c.2086G>A (p.Glu696Lys)

See Table A. Accordingly, an aspect of the invention relates to a method for treating or preventing ALS by correcting one or more pathogenic G-to-A or C-to-T mutations/SNPs, particularly one or more pathogenic G-to-A or C-to-T mutations/SNPs present in at least one gene selected from SOD1, VCP, UBQLN2, ERBB4, HNRNPA1, TUBA4A, SOD1, TARDBP, FIG. 4, OPTN, SETX, SPG11, FUS, VAPB, ANG, CHCHD10, SQSTM1, and TBK1, and more particularly one or more pathogenic G-to-A or C-to-T mutations/SNPs described above.

Schizophrenia

In some embodiments, the methods, systems, and compositions described herein are used to correct one or more pathogenic G-to-A or C-to-T mutations/SNPs associated with Schizophrenia. In some embodiment, the pathogenic mutations/SNPs are present in at least one gene selected from PRODH, SETD1A, and SHANK3, including at least the followings:

NM_016335.4(PRODH):c.1292G>A (p.Arg431His)
NM_016335.4(PRODH):c.1397C>T (p.Thr466Met)
NM_014712.2(SETD1A):c.2209C>T (p.Gln737Ter)
NM_033517.1(SHANK3):c.3349C>T (p.Arg1117Ter)
NM_033517.1(SHANK3):c.1606C>T (p.Arg536Trp)

See Table A. Accordingly, an aspect of the invention relates to a method for treating or preventing Schizophrenia by correcting one or more pathogenic G-to-A or C-to-T mutations/SNPs, particularly one or more pathogenic G-to-A or C-to-T mutations/SNPs present in at least one gene selected from PRODH, SETD1A, and SHANK3, and more particularly one or more pathogenic G-to-A or C-to-T mutations/SNPs described above.

Adrenoleukodystrophy

In some embodiments, the methods, systems, and compositions described herein are used to correct one or more pathogenic G-to-A or C-to-T mutations/SNPs associated with Adrenoleukodystrophy. In some embodiment, the pathogenic mutations/SNPs are present in at least the ABCD1 gene, including at least the followings:

NM_000033.3(ABCD1):c.421G>A (p.Ala141Thr)
NM_000033.3(ABCD1):c.796G>A (p.Gly266Arg)
NM_000033.3(ABCD1):c.1252C>T (p.Arg418Trp)
NM_000033.3(ABCD1):c.1552C>T (p.Arg518Trp)
NM_000033.3(ABCD1):c.1850G>A (p.Arg617His)
NM_000033.3(ABCD1):c.1396C>T (p.Gln466Ter)
NM_000033.3(ABCD1):c.1553G>A (p.Arg518Gln)
NM_000033.3(ABCD1):c.1679C>T (p.Pro560Leu)
NM_000033.3(ABCD1):c.1771C>T (p.Arg591Trp)
NM_000033.3(ABCD1):c.1802G>A (p.Trp601Ter)
NM_000033.3(ABCD1):c.346G>A (p.Gly116Arg)
NM_000033.3(ABCD1):c.406C>T (p.Gln136Ter)
NM_000033.3(ABCD1):c.1661G>A (p.Arg554His)
NM_000033.3(ABCD1):c.1825G>A (p.Glu609Lys)
NM_000033.3(ABCD1):c.1288C>T (p.Gln430Ter)
NM_000033.3(ABCD1):c.1781-1G>A
NM_000033.3(ABCD1):c.529C>T (p.Gln177Ter)
NM_000033.3(ABCD1):c.1866-10G>A

See Table A. Accordingly, an aspect of the invention relates to a method for treating or preventing Adrenoleukodystrophy by correcting one or more pathogenic G-to-A or C-to-T mutations/SNPs, particularly one or more pathogenic G-to-A or C-to-T mutations/SNPs present in at least the ABCD1 gene, and more particularly one or more pathogenic G-to-A or C-to-T mutations/SNPs described above.

Aicardi Goutieres Syndrome

In some embodiments, the methods, systems, and compositions described herein are used to correct one or more pathogenic G-to-A or C-to-T mutations/SNPs associated with Aicardi Goutieres syndrome. In some embodiment, the pathogenic mutations/SNPs are present in at least one gene selected from TREX1, RNASEH2C, ADAR, and IFIH1, including at least the followings:

NM_016381.5(TREX1):c.794G>A (p.Trp265Ter)
NM_033629.4(TREX1):c.52G>A (p.Asp18Asn)
NM_033629.4(TREX1):c.490C>T (p.Arg164Ter)
NM_032193.3(RNASEH2C):c.205C>T (p.Arg69Trp)
NM_001111.4(ADAR):c.3019G>A (p.Gly1007Arg)
NM_022168.3(IFIH1):c.2336G>A (p.Arg779His)
NM_022168.3(IFIH1):c.2335C>T (p.Arg779Cys)

See Table A. Accordingly, an aspect of the invention relates to a method for treating or preventing Aicardi Goutieres syndrome by correcting one or more pathogenic G-to-A or C-to-T mutations/SNPs, particularly one or more pathogenic G-to-A or C-to-T mutations/SNPs present in at least one gene selected from TREX1, RNASEH2C, ADAR, and IFIH1, and more particularly one or more pathogenic G-to-A or C-to-T mutations/SNPs described above.

Fabry Disease

In some embodiments, the methods, systems, and compositions described herein are used to correct one or more pathogenic G-to-A or C-to-T mutations/SNPs associated with Fabry disease. In some embodiment, the pathogenic mutations/SNPs are present in at least the GLA gene, including at least the followings:

NM_000169.2(GLA):c.1024C>T (p.Arg342Ter)
NM_000169.2(GLA):c.1066C>T (p.Arg356Trp)
NM_000169.2(GLA):c.1025G>A (p.Arg342Gln)
NM_000169.2(GLA):c.281G>A (p.Cys94Tyr)
NM_000169.2(GLA):c.677G>A (p.Trp226Ter)
NM_000169.2(GLA):c.734G>A (p.Trp245Ter)
NM_000169.2(GLA):c.748C>T (p.Gln250Ter)
NM_000169.2(GLA):c.658C>T (p.Arg220Ter)
NM_000169.2(GLA):c.730G>A (p.Asp244Asn)
NM_000169.2(GLA):c.369+1G>A
NM_000169.2(GLA):c.335G>A (p.Arg112His)
NM_000169.2(GLA):c.485G>A (p.Trp162Ter)
NM_000169.2(GLA):c.661C>T (p.Gln221Ter)
NM_000169.2(GLA):c.916C>T (p.Gln306Ter)
NM_000169.2(GLA):c.1072G>A (p.Glu358Lys)
NM_000169.2(GLA):c.1087C>T (p.Arg363Cys)
NM_000169.2(GLA):c.1088G>A (p.Arg363His)
NM_000169.2(GLA):c.605G>A (p.Cys202Tyr)
NM_000169.2(GLA):c.830G>A (p.Trp277Ter)
NM_000169.2(GLA):c.979C>T (p.Gln327Ter)
NM_000169.2(GLA):c.422C>T (p.Thr141Ile)
NM_000169.2(GLA):c.285G>A (p.Trp95Ter)
NM_000169.2(GLA):c.735G>A (p.Trp245Ter)
NM_000169.2(GLA):c.639+919G>A
NM_000169.2(GLA):c.680G>A (p.Arg227Gln)
NM_000169.2(GLA):c.679C>T (p.Arg227Ter)
NM_000169.2(GLA):c.242G>A (p.Trp81Ter)
NM_000169.2(GLA):c.901C>T (p.Arg301Ter)
NM_000169.2(GLA):c.974G>A (p.Gly325Asp)
NM_000169.2(GLA):c.847C>T (p.Gln283Ter)
NM_000169.2(GLA):c.469C>T (p.Gln157Ter)
NM_000169.2(GLA):c.1118G>A (p.Gly373Asp)

See Table A. Accordingly, an aspect of the invention relates to a method for treating or preventing Fabry disease by correcting one or more pathogenic G-to-A or C-to-T mutations/SNPs, particularly one or more pathogenic G-to-A or C-to-T mutations/SNPs present in at least the GLA gene, and more particularly one or more pathogenic G-to-A or C-to-T mutations/SNPs described above.

Lesch-Nyhan Syndrome

In some embodiments, the methods, systems, and compositions described herein are used to correct one or more pathogenic G-to-A or C-to-T mutations/SNPs associated with Lesch-Nyhan syndrome. In some embodiment, the pathogenic mutations/SNPs are present in at least the HPRT1 gene, including at least the followings:

NM_000194.2(HPRT1):c.151C>T (p.Arg51Ter)
NM_000194.2(HPRT1):c.384+1G>A

See Table A. Accordingly, an aspect of the invention relates to a method for treating or preventing Lesch-Nyhan syndrome by correcting one or more pathogenic G-to-A or C-to-T mutations/SNPs, particularly one or more pathogenic G-to-A or C-to-T mutations/SNPs present in at least the HPRT1 gene, and more particularly one or more pathogenic G-to-A or C-to-T mutations/SNPs described above.

Menkes Disease

In some embodiments, the methods, systems, and compositions described herein are used to correct one or more pathogenic G-to-A or C-to-T mutations/SNPs associated with Menkes Disease. In some embodiment, the pathogenic mutations/SNPs are present in at least the ATP7A gene, including at least the followings:

NM_000052.6(ATP7A):c.601C>T (p.Arg201Ter)
NM_000052.6(ATP7A):c.2938C>T (p.Arg980Ter)
NM_000052.6(ATP7A):c.3056G>A (p.Gly1019Asp)
NM_000052.6(ATP7A):c.598C>T (p.Gln200Ter)
NM_000052.6(ATP7A):c.1225C>T (p.Arg409Ter)
NM_000052.6(ATP7A):c.1544-1G>A
NM_000052.6(ATP7A): c.1639C>T (p.Arg547Ter)
NM_000052.6(ATP7A):c.1933C>T (p.Arg645Ter)
NM_000052.6(ATP7A):c.1946+5G>A
NM_000052.6(ATP7A):c.1950G>A (p.Trp650Ter)
NM_000052.6(ATP7A):c.2179G>A (p.Gly727Arg)
NM_000052.6(ATP7A):c.2187G>A (p.Trp729Ter)
NM_000052.6(ATP7A):c.2383C>T (p.Arg795Ter)
NM_000052.6(ATP7A):c.2499-1G>A
NM_000052.6(ATP7A):c.2555C>T (p.Pro852Leu)
NM_000052.6(ATP7A):c.2956C>T (p.Arg986Ter)
NM_000052.6(ATP7A):c.3112-1G>A
NM_000052.6(ATP7A):c.3466C>T (p.Gln1156Ter)
NM_000052.6(ATP7A):c.3502C>T (p.Gln1168Ter)
NM_000052.6(ATP7A):c.3764G>A (p.Gly1255Glu)
NM_000052.6(ATP7A):c.3943G>A (p.Gly1315Arg)
NM_000052.6(ATP7A):c.4123+1G>A
NM_000052.6(ATP7A):c.4226+5G>A

See Table A. Accordingly, an aspect of the invention relates to a method for treating or preventing Menkes Disease by correcting one or more pathogenic G-to-A or C-to-T mutations/SNPs, particularly one or more pathogenic G-to-A or C-to-T mutations/SNPs present in at least the ATP7A gene, and more particularly one or more pathogenic G-to-A or C-to-T mutations/SNPs described above.

Eye Diseases

Pathogenic G-to-A or C-to-T mutations/SNPs associated with various eye diseases are reported in the ClinVar database and disclosed in Table A, including but not limited to Stargardt Disease, Bardet-Biedl Syndrome, Cone-rod dystrophy, Congenital Stationary Night Blindness, Usher Syndrome, Leber Congenital Amaurosis, Retinitis Pigmentosa, and Achromatopsia. Accordingly, an aspect of the invention relates to a method for correcting one or more pathogenic G-to-A or C-to-T mutations/SNPs associated with any of these diseases, as discussed below.

Stargardt Disease

In some embodiments, the methods, systems, and compositions described herein are used to correct one or more pathogenic G-to-A or C-to-T mutations/SNPs associated with Stargardt Disease. In some embodiment, the pathogenic mutations/SNPs are present in the ABCA4 gene, including at least the followings:

NM_000350.2(ABCA4):c.4429C>T (p.Gln1477Ter)
NM_000350.2(ABCA4):c.6647C>T (p.Ala2216Val)
NM_000350.2(ABCA4):c.5312+1G>A
NM_000350.2(ABCA4):c.5189G>A (p.Trp1730Ter)
NM_000350.2(ABCA4): c.4352+1G>A
NM_000350.2(ABCA4):c.4253+5G>A
NM_000350.2(ABCA4):c.3871C>T (p.Gln1291Ter)
NM_000350.2(ABCA4):c.3813G>A (p.Glu1271=)
NM_000350.2(ABCA4):c.1293G>A (p.Trp431Ter)
NM_000350.2(ABCA4):c.206G>A (p.Trp69Ter)
NM_000350.2(ABCA4):c.3322C>T (p.Arg1108Cys)
NM_000350.2(ABCA4):c.1804C>T (p.Arg602Trp)
NM_000350.2(ABCA4): c.1937+1G>A
NM_000350.2(ABCA4):c.2564G>A (p.Trp855Ter)
NM_000350.2(ABCA4):c.4234C>T (p.Gln1412Ter)
NM_000350.2(ABCA4):c.4457C>T (p.Pro1486Leu)
NM_000350.2(ABCA4):c.4594G>A (p.Asp1532Asn)

NM_000350.2(ABCA4):c.4919G>A (p.Arg1640Gln)
NM_000350.2(ABCA4):c.5196+1G>A
NM_000350.2(ABCA4):c.6316C>T (p.Arg2106Cys)
NM_000350.2(ABCA4):c.3056C>T (p.Thr1019Met)
NM_000350.2(ABCA4):c.52C>T (p.Arg18Trp)
NM_000350.2(ABCA4):c.122G>A (p.Trp41Ter)
NM_000350.2(ABCA4):c.1903C>T (p.Gln635Ter)
NM_000350.2(ABCA4):c.194G>A (p.Gly65Glu)
NM_000350.2(ABCA4):c.3085C>T (p.Gln1029Ter)
NM_000350.2(ABCA4):c.4195G>A (p.Glu1399Lys)
NM_000350.2(ABCA4):c.454C>T (p.Arg152Ter)
NM_000350.2(ABCA4):c.45G>A (p.Trp15Ter)
NM_000350.2(ABCA4):c.4610C>T (p.Thr1537Met)
NM_000350.2(ABCA4):c.6112C>T (p.Arg2038Trp)
NM_000350.2(ABCA4):c.6118C>T (p.Arg2040Ter)
NM_000350.2(ABCA4):c.6342G>A (p.Val2114=)
NM_000350.2(ABCA4):c.6658C>T (p.Gln2220Ter)

See Table A. Accordingly, an aspect of the invention relates to a method for treating or preventing Stargardt Disease by correcting one or more pathogenic G-to-A or C-to-T mutations/SNPs, particularly one or more pathogenic G-to-A or C-to-T mutations/SNPs present in the ABCA4 gene, and more particularly one or more pathogenic G-to-A or C-to-T mutations/SNPs described above.

Bardet-Biedl Syndrome

In some embodiments, the methods, systems, and compositions described herein are used to correct one or more pathogenic G-to-A or C-to-T mutations/SNPs associated with Bardet-Biedl Syndrome. In some embodiment, the pathogenic mutations/SNPs are present in at least one gene selected from BBS1, BBS2, BBS7, BBS9, BBS10, BBS12, LZTFL1, and TRIM32, including at least the followings:
NM_024649.4(BBS1):c.416G>A (p.Trp139Ter)
NM_024649.4(BBS1):c.871C>T (p.Gln291Ter)
NM_198428.2(BBS9):c.263+1G>A
NM_001178007.1(BBS12):c.1704G>A (p.Trp568Ter)
NM_001276378.1(LZTFL1):c.271C>T (p.Arg91Ter)
NM_031885.3(BBS2):c.1864C>T (p.Arg622Ter)
NM_198428.2(BBS9):c.1759C>T (p.Arg587Ter)
NM_198428.2(BBS9):c.1789+1G>A
NM_024649.4(BBS1):c.432+1G>A
NM_176824.2(BBS7):c.632C>T (p.Thr211Ile)
NM_012210.3(TRIM32):c.388C>T (p.Pro130Ser)
NM_031885.3(BBS2):c.823C>T (p.Arg275Ter)
NM_024685.3(BBS10):c.145C>T (p.Arg49Trp)

See Table A. Accordingly, an aspect of the invention relates to a method for treating or preventing Bardet-Biedl Syndrome by correcting one or more pathogenic G-to-A or C-to-T mutations/SNPs, particularly one or more pathogenic G-to-A or C-to-T mutations/SNPs present in at least one gene selected from BBS1, BBS2, BBS7, BBS9, BBS10, BBS12, LZTFL1, and TRIM32, and more particularly one or more pathogenic G-to-A or C-to-T mutations/SNPs described above.

Cone-Rod Dystrophy

In some embodiments, the methods, systems, and compositions described herein are used to correct one or more pathogenic G-to-A or C-to-T mutations/SNPs associated with Cone-rod dystrophy. In some embodiment, the pathogenic mutations/SNPs are present in at least one gene selected from RPGRIP1, DRAM2, ABCA4, ADAM9, and CACNA1F, including at least the followings:
NM_020366.3(RPGRIP1):c.154C>T (p.Arg52Ter)
NM_178454.5(DRAM2):c.494G>A (p.Trp165Ter)
NM_178454.5(DRAM2):c.131G>A (p.Ser44Asn)
NM_000350.2(ABCA4):c.161G>A (p.Cys54Tyr)
NM_000350.2(ABCA4):c.5714+5G>A
NM_000350.2(ABCA4):c.880C>T (p.Gln294Ter)
NM_000350.2(ABCA4):c.6079C>T (p.Leu2027Phe)
NM_000350.2(ABCA4):c.3113C>T (p.Ala1038Val)
NM_000350.2(ABCA4):c.634C>T (p.Arg212Cys)
NM_003816.2(ADAM9):c.490C>T (p.Arg164Ter)
NM_005183.3(CACNA1F):c.244C>T (p.Arg82Ter)

See Table A. Accordingly, an aspect of the invention relates to a method for treating or preventing Cone-rod dystrophy by correcting one or more pathogenic G-to-A or C-to-T mutations/SNPs, particularly one or more pathogenic G-to-A or C-to-T mutations/SNPs present in at least one gene selected from RPGRIP1, DRAM2, ABCA4, ADAM9, and CACNA1F, and more particularly one or more pathogenic G-to-A or C-to-T mutations/SNPs described above.

Congenital Stationary Night Blindness

In some embodiments, the methods, systems, and compositions described herein are used to correct one or more pathogenic G-to-A or C-to-T mutations/SNPs associated with Congenital Stationary Night Blindness. In some embodiment, the pathogenic mutations/SNPs are present in at least one gene selected from GRM6, TRPM1, GPR179, and CACNA1F, including at least the followings:
NM_000843.3(GRM6):c.1462C>T (p.Gln488Ter)
NM_002420.5(TRPM1):c.2998C>T (p.Arg1000Ter)
NM_001004334.3(GPR179):c.673C>T (p.Gln225Ter)
NM_005183.3(CACNA1F):c.2576+1G>A See Table A. Accordingly, an aspect of the invention relates to a method for treating or preventing Congenital Stationary Night Blindness by correcting one or more pathogenic G-to-A or C-to-T mutations/SNPs, particularly one or more pathogenic G-to-A or C-to-T mutations/SNPs present in at least one gene selected from GRM6, TRPM1, GPR179, and CACNA1F, and more particularly one or more pathogenic G-to-A or C-to-T mutations/SNPs described above.

Usher Syndrome

In some embodiments, the methods, systems, and compositions described herein are used to correct one or more pathogenic G-to-A or C-to-T mutations/SNPs associated with Usher Syndrome. In some embodiment, the pathogenic mutations/SNPs are present in at least one gene selected from MYO7A, USH1C, CDH23, PCDH15, USH2A, ADGRV1, WHRN, and CLRN1, including at least the followings:
NM_000260.3(MYO7A):c.640G>A (p.Gly214Arg)
NM_000260.3(MYO7A): c.1200+1G>A
NM_000260.3(MYO7A): c.141G>A (p. Trp47Ter)
NM_000260.3(MYO7A):c.1556G>A (p.Gly519Asp)
NM_000260.3(MYO7A):c.1900C>T (p.Arg634Ter)
NM_000260.3(MYO7A):c.1963C>T (p.Gln655Ter)
NM_000260.3(MYO7A):c.2094+1G>A
NM_000260.3(MYO7A): c.4293G>A (p.Trp1431Ter)
NM_000260.3(MYO7A):c.5101C>T (p.Arg1701Ter)
NM_000260.3(MYO7A):c.5617C>T (p.Arg1873Trp)
NM_000260.3(MYO7A):c.5660C>T (p.Pro1887Leu)
NM_000260.3(MYO7A):c.6070C>T (p.Arg2024Ter)
NM_000260.3(MYO7A): c.470+1G>A
NM_000260.3(MYO7A):c.5968C>T (p.Gln1990Ter)
NM_000260.3(MYO7A):c.3719G>A (p.Arg1240Gln)
NM_000260.3(MYO7A):c.494C>T (p.Thr165Met)
NM_000260.3(MYO7A):c.5392C>T (p.Gln1798Ter)
NM_000260.3(MYO7A):c.5648G>A (p.Arg1883Gln)
NM_000260.3(MYO7A):c.448C>T (p.Arg150Ter)
NM_000260.3(MYO7A):c.700C>T (p.Gln234Ter)
NM_000260.3(MYO7A):c.635G>A (p.Arg212His)
NM_000260.3(MYO7A):c.1996C>T (p.Arg666Ter)
NM_005709.3(USH1C):c.216G>A (p.Val72=)
NM_022124.5(CDH23):c.7362+5G>A NM_022124.5(CDH23):c.3481C>T (p.Arg1161Ter)
NM_022124.5(CDH23):c.3628C>T (p.Gln1210Ter)
NM_022124.5(CDH23):c.5272C>T (p.Gln1758Ter)
NM_022124.5(CDH23):c.5712+1G>A
NM_022124.5(CDH23):c.5712G>A (p.Thr1904=)
NM_022124.5(CDH23):c.5923+1G>A
NM_022124.5(CDH23):c.6049+1G>A
NM_022124.5(CDH23):c.7776G>A (p.Trp2592Ter)
NM_022124.5(CDH23):c.9556C>T (p.Arg3186Ter)
NM_022124.5(CDH23):c.3706C>T (p.Arg1236Ter)
NM_022124.5(CDH23):c.4309C>T (p.Arg1437Ter)
NM_022124.5(CDH23):c.6050-9G>A
NM_033056.3(PCDH15):c.3316C>T (p.Arg1106Ter)
NM_033056.3(PCDH15):c.7C>T (p.Arg3Ter)
NM_033056.3(PCDH15):c.1927C>T (p.Arg643Ter)
NM_001142772.1(PCDH15):c.400C>T (p.Arg134Ter)
NM_033056.3(PCDH15):c.3358C>T (p.Arg1120Ter)
NM_206933.2(USH2A):c.11048-1G>A
NM_206933.2(USH2A):c.1143+1G>A
NM_206933.2(USH2A):c.11954G>A (p.Trp3985Ter)
NM_206933.2(USH2A):c.12868C>T (p.Gln4290Ter)
NM_206933.2(USH2A):c.14180G>A (p.Trp4727Ter)
NM_206933.2(USH2A):c.14911C>T (p.Arg4971Ter)
NM_206933.2(USH2A):c.5788C>T (p.Arg1930Ter)
NM_206933.2(USH2A):c.5858-1G>A
NM_206933.2(USH2A):c.6224G>A (p.Trp2075Ter)
NM_206933.2(USH2A):c.820C>T (p.Arg274Ter)
NM_206933.2(USH2A):c.8981G>A (p.Trp2994Ter)
NM_206933.2(USH2A):c.9304C>T (p.Gln3102Ter)
NM_206933.2(USH2A):c.13010C>T (p.Thr4337Met)
NM_206933.2(USH2A):c.14248C>T (p.Gln4750Ter)
NM_206933.2(USH2A):c.6398G>A (p.Trp2133Ter)
NM_206933.2(USH2A):c.632G>A (p.Trp211Ter)
NM_206933.2(USH2A):c.6601C>T (p.Gln2201Ter)
NM_206933.2(USH2A):c.13316C>T (p.Thr4439Ile)
NM_206933.2(USH2A):c.4405C>T (p.Gln1469Ter)
NM_206933.2(USH2A):c.9570+1G>A
NM_206933.2(USH2A):c.8740C>T (p.Arg2914Ter)
NM_206933.2(USH2A):c.8681+1G>A
NM_206933.2(USH2A):c.1000C>T (p.Arg334Trp)
NM_206933.2(USH2A):c.14175G>A (p.Trp4725Ter)
NM_206933.2(USH2A):c.9390G>A (p.Trp3130Ter)
NM_206933.2(USH2A):c.908G>A (p.Arg303His)
NM_206933.2(USH2A):c.5776+1G>A
NM_206933.2(USH2A):c.11156G>A (p.Arg3719His)
NM_032119.3(ADGRV1):c.2398C>T (p.Arg800Ter)
NM_032119.3(ADGRV1):c.7406G>A (p.Trp2469Ter)
NM_032119.3(ADGRV1):c.12631C>T (p.Arg4211Ter)
NM_032119.3(ADGRV1):c.7129C>T (p.Arg2377Ter)
NM_032119.3(ADGRV1):c.14885G>A (p.Trp4962Ter)
NM_015404.3(WHRN):c.1267C>T (p.Arg423Ter)
NM_174878.2(CLRN1):c.619C>T (p.Arg207Ter)

See Table A. Accordingly, an aspect of the invention relates to a method for treating or preventing Enhanced Usher Syndrome by correcting one or more pathogenic G-to-A or C-to-T mutations/SNPs, particularly one or more pathogenic G-to-A or C-to-T mutations/SNPs present in at least one gene selected from MYO7A, USH1C, CDH23, PCDH15, USH2A, ADGRV1, WHRN, and CLRN1, and more particularly one or more pathogenic G-to-A or C-to-T mutations/SNPs described above.

Leber Congenital Amaurosis

In some embodiments, the methods, systems, and compositions described herein are used to correct one or more pathogenic G-to-A or C-to-T mutations/SNPs associated with Leber Congenital Amaurosis. In some embodiment, the pathogenic mutations/SNPs are present in at least one gene selected from TULP1, RPE65, SPATA7, AIPL1, CRB1, NMNAT1, and PEX1, including at least the followings:
NM_003322.5(TULP1):c.1495+1G>A
NM_000329.2(RPE65):c.11+5G>A
NM_018418.4(SPATA7):c.322C>T (p.Arg108Ter)
NM_014336.4(AIPL1):c.784G>A (p.Gly262Ser)
NM_201253.2(CRB1):c.1576C>T (p.Arg526Ter)
NM_201253.2(CRB1):c.3307G>A (p.Gly1103Arg)
NM_201253.2(CRB1):c.2843G>A (p.Cys948Tyr)
NM_022787.3(NMNAT1):c.769G>A (p.Glu257Lys)
NM_000466.2(PEX1):c.2528G>A (p.Gly843Asp)

See Table A. Accordingly, an aspect of the invention relates to a method for treating or preventing Leber Congenital Amaurosis by correcting one or more pathogenic G-to-A or C-to-T mutations/SNPs, particularly one or more pathogenic G-to-A or C-to-T mutations/SNPs present in at least one gene selected from TULP1, RPE65, SPATA7, AIPL1, CRB1, NMNAT1, and PEX1, and more particularly one or more pathogenic G-to-A or C-to-T mutations/SNPs described above.

Retinitis Pigmentosa

In some embodiments, the methods, systems, and compositions described herein are used to correct one or more pathogenic G-to-A or C-to-T mutations/SNPs associated with Retinitis Pigmentosa. In some embodiment, the pathogenic mutations/SNPs are present in at least one gene selected from CRB1, IFT140, RP1, IMPDH1, PRPF31, RPGR, ABCA4, RPE65, EYS, NRL, FAM161A, NR2E3, USH2A, RHO, PDE6B, KLHL7, PDE6A, CNGB1, BEST1, C2orf71, PRPH2, CA4, CERKL, RPE65, PDE6B, and ADGRV1, including at least the followings:
NM_001257965.1(CRB1):c.2711G>A (p.Cys904Tyr)
NM_014714.3(IFT140):c.3827G>A (p.Gly1276Glu)
NM_006269.1(RP1):c.2029C>T (p.Arg677Ter)
NM_000883.3(IMPDH1):c.931G>A (p.Asp311Asn)
NM_015629.3(PRPF31):c.1273C>T (p.Gln425Ter)
NM_015629.3(PRPF31): c.1073+1G>A
NM_000328.2(RPGR):c.1387C>T (p.Gln463Ter)
NM_000350.2(ABCA4):c.4577C>T (p.Thr1526Met)
NM_000350.2(ABCA4):c.6229C>T (p.Arg2077Trp)
NM_000329.2(RPE65):c.271C>T (p.Arg91Trp)
NM_001142800.1(EYS):c.2194C>T (p.Gln732Ter)
NM_001142800.1(EYS):c.490C>T (p.Arg164Ter)
NM_006177.3(NRL):c.151C>T (p.Pro51Ser)
NM_001201543.1(FAM161A):c.1567C>T (p.Arg523Ter)
NM_014249.3(NR2E3):c.166G>A (p.Gly56Arg)
NM_206933.2(USH2A):c.2209C>T (p.Arg737Ter)
NM_206933.2(USH2A):c.14803C>T (p.Arg4935Ter)
NM_206933.2(USH2A):c.10073G>A (p.Cys3358Tyr)
NM_000539.3(RHO):c.541G>A (p.Glu181Lys)
NM_000283.3(PDE6B):c.892C>T (p.Gln298Ter)
NM_001031710.2(KLHL7):c.458C>T (p.Ala153Val)
NM_000440.2(PDE6A):c.1926+1G>A
NM_001297.4(CNGB1):c.2128C>T (p.Gln710Ter)
NM_001297.4(CNGB1):c.952C>T (p.Gln318Ter)
NM_004183.3(BEST1):c.682G>A (p.Asp228Asn)
NM_001029883.2(C2orf71):c.1828C>T (p.Gln610Ter)
NM_000322.4(PRPH2):c.647C>T (p.Pro216Leu)
NM_000717.4(CA4):c.40C>T (p.Arg14Trp)
NM_201548.4(CERKL):c.769C>T (p.Arg257Ter)
NM_000329.2(RPE65):c. 118G>A (p.Gly40Ser)
NM_000322.4(PRPH2):c.499G>A (p.Gly167Ser)
NM_000539.3(RHO):c.403C>T (p.Arg135Trp)
NM_000283.3(PDE6B): c.2193+1G>A
NM_032119.3(ADGRV1):c.6901C>T (p.Gln2301Ter)

See Table A. Accordingly, an aspect of the invention relates to a method for treating or preventing Retinitis Pigmentosa by correcting one or more pathogenic G-to-A or C-to-T mutations/SNPs, particularly one or more pathogenic G-to-A or C-to-T mutations/SNPs present in at least one gene selected from CRB1, IFT140, RP1, IMPDH1, PRPF31, RPGR, ABCA4, RPE65, EYS, NRL, FAM161A, NR2E3, USH2A, RHO, PDE6B, KLHL7, PDE6A, CNGB1, BEST1, C2orf71, PRPH2, CA4, CERKL, RPE65, PDE6B, and ADGRV1, and more particularly one or more pathogenic G-to-A or C-to-T mutations/SNPs described above.

Achromatopsia

In some embodiments, the methods, systems, and compositions described herein are used to correct one or more pathogenic G-to-A or C-to-T mutations/SNPs associated with Achromatopsia. In some embodiment, the pathogenic mutations/SNPs are present in at least one gene selected from CNGA3, CNGB3, and ATF6, including at least the followings:

NM_001298.2(CNGA3):c.847C>T (p.Arg283Trp)
  NM_001298.2(CNGA3):c.101+1G>A
  NM_001298.2(CNGA3):c.1585G>A (p.Val529Met)
  NM_019098.4(CNGB3):c.1578+1G>A
  NM_019098.4(CNGB3):c.607C>T (p.Arg203Ter)
  NM_019098.4(CNGB3):c.1119G>A (p.Trp373Ter)
  NM_007348.3(ATF6):c.970C>T (p.Arg324Cys)

See Table A. Accordingly, an aspect of the invention relates to a method for treating or preventing Achromatopsia by correcting one or more pathogenic G-to-A or C-to-T mutations/SNPs, particularly one or more pathogenic G-to-A or C-to-T mutations/SNPs present in at least one gene selected from CNGA3, CNGB3, and ATF6, and more particularly one or more pathogenic G-to-A or C-to-T mutations/SNPs described above.

Diseases Affecting Hearing

Pathogenic G-to-A or C-to-T mutations/SNPs associated with various diseases affecting hearing are reported in the ClinVar database and disclosed in Table A, including but not limited to deafness and Nonsyndromic hearing loss. Accordingly, an aspect of the invention relates to a method for correcting one or more pathogenic G-to-A or C-to-T mutations/SNPs associated with any of these diseases, as discussed below.

Deafness

In some embodiments, the methods, systems, and compositions described herein are used to correct one or more pathogenic G-to-A or C-to-T mutations/SNPs associated with deafness. In some embodiment, the pathogenic mutations/SNPs are present in at least one gene selected from FGF3, MYO7A, STRC, ACTG1, SLC17A8, TMC1, GJB2, MYH14, COCH, CDH23, USH1C, GJB2, MYO7A, PCDH15, MYO15A, MYO3A, WHRN, DFNB59, TMC1, LOXHD1, TMPRSS3, OTOGL, OTOF, JAG1, and MARVELD2, including at least the followings:

NM_005247.2(FGF3):c.283C>T (p.Arg95Trp)
  NM_000260.3(MYO7A):c.652G>A (p.Asp218Asn)
  NM_000260.3(MYO7A):c.689C>T (p.Ala230Val)
  NM_153700.2(STRC):c.4057C>T (p.Gln1353Ter)
  NM_001614.3(ACTG1):c.721G>A (p.Glu241Lys)
  NM_139319.2(SLC17A8):c.632C>T (p.Ala211Val)
  NM_138691.2(TMC1):c.1714G>A (p.Asp572Asn)
  NM_004004.5(GJB2):c.598G>A (p.Gly200Arg)
  NM_004004.5(GJB2):c.71G>A (p.Trp24Ter)
  NM_004004.5(GJB2):c.416G>A (p.Ser139Asn)
  NM_004004.5(GJB2):c.224G>A (p.Arg75Gln)
  NM_004004.5(GJB2):c.95G>A (p.Arg32His)
  NM_004004.5(GJB2):c.250G>A (p.Val84Met)
  NM_004004.5(GJB2):c.428G>A (p.Arg143Gln)
  NM_004004.5(GJB2):c.551G>A (p.Arg184Gln)
  NM_004004.5(GJB2):c.223C>T (p.Arg75Trp)
  NM_024729.3(MYH14):c.359C>T (p.Ser120Leu)
  NM_004086.2(COCH):c.151C>T (p.Pro51Ser)
  NM_022124.5(CDH23):c.4021G>A (p.Asp1341Asn)
  NM_153700.2(STRC):c.4701+1G>A
  NM_153676.3(USH1C):c.496+1G>A
  NM_004004.5(GJB2):c.131G>A (p.Trp44Ter)
  NM_004004.5(GJB2):c.283G>A (p.Val95Met)
  NM_004004.5(GJB2):c.298C>T (p.His100Tyr)
  NM_004004.5(GJB2):c.427C>T (p.Arg143Trp)
  NM_004004.5(GJB2):c.109G>A (p.Val37Ile)
  NM_004004.5(GJB2): c.-23+1G>A
  NM_004004.5(GJB2):c.148G>A (p.Asp50Asn)
  NM_004004.5(GJB2):c.134G>A (p.Gly45Glu)
  NM_004004.5(GJB2):c.370C>T (p.Gln124Ter)
  NM_004004.5(GJB2):c.230G>A (p.Trp77Ter)
  NM_004004.5(GJB2):c.231G>A (p.Trp77Ter)
  NM_000260.3(MYO7A):c.5899C>T (p.Arg1967Ter)
  NM_000260.3(MYO7A):c.2005C>T (p.Arg669Ter)
  NM_033056.3(PCDH15):c.733C>T (p.Arg245Ter)
  NM_016239.3(MYO15A): c.3866+1G>A
  NM_016239.3(MYO15A):c.6178-1G>A
  NM_016239.3(MYO15A):c.8714-1G>A
  NM_017433.4(MYO3A): c.2506-1G>A
  NM_015404.3(WHRN): c.1417-1G>A
  NM_001042702.3(DFNB59):c.499C>T (p.Arg167Ter)
  NM_138691.2(TMC1):c.100C>T (p.Arg34Ter)
  NM_138691.2(TMC1):c.1165C>T (p.Arg389Ter)
  NM_144612.6(LOXHD1):c.2008C>T (p.Arg670Ter)
  NM_144612.6(LOXHD1):c.4714C>T (p.Arg1572Ter)
  NM_144612.6(LOXHD1):c.4480C>T (p.Arg1494Ter)
  NM_024022.2(TMPRSS3):c.325C>T (p.Arg109Trp)
  NM_173591.3(OTOGL):c.3076C>T (p.Gln1026Ter)
  NM_194248.2(OTOF):c.4483C>T (p.Arg1495Ter)
  NM_194248.2(OTOF):c.2122C>T (p.Arg708Ter)
  NM_194248.2(OTOF):c.2485C>T (p.Gln829Ter)
  NM_001038603.2(MARVELD2):c.1498C>T (p.Arg500Ter)

See Table A. Accordingly, an aspect of the invention relates to a method for treating or preventing deafness by correcting one or more pathogenic G-to-A or C-to-T mutations/SNPs, particularly one or more pathogenic G-to-A or C-to-T mutations/SNPs present in at least one gene selected from FGF3, MYO7A, STRC, ACTG1, SLC17A8, TMC1, GJB2, MYH14, COCH, CDH23, USH1C, GJB2, MYO7A, PCDH15, MYO15A, MYO3A, WHRN, DFNB59, TMC1, LOXHD1, TMPRSS3, OTOGL, OTOF, JAG1, and MARVELD2, and more particularly one or more pathogenic G-to-A or C-to-T mutations/SNPs described above.

Nonsyndromic Hearing Loss

In some embodiments, the methods, systems, and compositions described herein are used to correct one or more pathogenic G-to-A or C-to-T mutations/SNPs associated with Nonsyndromic hearing loss. In some embodiment, the pathogenic mutations/SNPs are present in at least one gene selected from GJB2, POU3F4, MYO15A, TMPRSS3, LOXHD1, OTOF, MYO6, OTOA, STRC, TRIOBP, MARVELD2, TMC1, TECTA, OTOGL, and GIPC3, including at least the followings:

NM_004004.5(GJB2):c.169C>T (p.Gln57Ter)
  NM_000307.4(POU3F4):c.499C>T (p.Arg167Ter)
  NM_016239.3(MYO15A):c.8767C>T (p.Arg2923Ter)
  NM_024022.2(TMPRSS3): c.323-6G>A
  NM_024022.2(TMPRSS3):c.916G>A (p.Ala306Thr)
  NM_144612.6(LOXHD1):c.2497C>T (p.Arg833Ter)

NM_194248.2(OTOF):c.2153G>A (p.Trp718Ter)
NM_194248.2(OTOF):c.2818C>T (p.Gln940Ter)
NM_194248.2(OTOF):c.4799+1G>A
NM_004999.3(MYO6):c.826C>T (p.Arg276Ter)
NM_144672.3(OTOA):c.1880+1G>A
NM_153700.2(STRC):c.5188C>T (p.Arg1730Ter)
NM_153700.2(STRC):c.3670C>T (p.Arg1224Ter)
NM_153700.2(STRC):c.4402C>T (p.Arg1468Ter)
NM_024022.2(TMPRSS3):c.1192C>T (p.Gln398Ter)
NM_001039141.2(TRIOBP):c.6598C>T (p.Arg2200Ter)
NM_016239.3(MYO15A): c.7893+1G>A
NM_016239.3(MYO15A):c.5531+1G>A
NM_016239.3(MYO15A): c.6046+1G>A
NM_144612.6(LOXHD1):c.3169C>T (p.Arg1057Ter)
NM_001038603.2(MARVELD2):c.1331+1G>A
NM_138691.2(TMC1):c.1676G>A (p.Trp559Ter)
NM_138691.2(TMC1):c.1677G>A (p.Trp559Ter)
NM_005422.2(TECTA):c.5977C>T (p.Arg1993Ter)
NM_173591.3(OTOGL):c.4987C>T (p.Arg1663Ter)
NM_153700.2(STRC):c.3493C>T (p.Gln1165Ter)
NM_153700.2(STRC):c.3217C>T (p.Arg1073Ter)
NM_016239.3(MYO15A):c.5896C>T (p.Arg1966Ter)
NM_133261.2(GIPC3):c.411+1G>A

See Table A. Accordingly, an aspect of the invention relates to a method for treating or preventing Nonsyndromic hearing loss by correcting one or more pathogenic G-to-A or C-to-T mutations/SNPs, particularly one or more pathogenic G-to-A or C-to-T mutations/SNPs present in at least one gene selected from GJB2, POU3F4, MYO15A, TMPRSS3, LOXHD1, OTOF, MYO6, OTOA, STRC, TRIOBP, MARVELD2, TMC1, TECTA, OTOGL, and GIPC3, and more particularly one or more pathogenic G-to-A or C-to-T mutations/SNPs described above.

Blood Disorders

Pathogenic G-to-A or C-to-T mutations/SNPs associated with various blood disorders are reported in the ClinVar database and disclosed in Table A, including but not limited to Beta-thalassemia, Hemophilia A, Hemophilia B, Hemophilia C, and Wiskott-Aldrich syndrome. Accordingly, an aspect of the invention relates to a method for correcting one or more pathogenic G-to-A or C-to-T mutations/SNPs associated with any of these diseases, as discussed below.

Beta-Thalassemia

In some embodiments, the methods, systems, and compositions described herein are used to correct one or more pathogenic G-to-A or C-to-T mutations/SNPs associated with Beta-thalassemia. In some embodiment, the pathogenic mutations/SNPs are present in at least the HBB gene, including at least the followings:
  NM_000518.4(HBB):c.-137C>T
  NM_000518.4(HBB):c.-50-88C>T
  NM_000518.4(HBB):c.-140C>T
  NM_000518.4(HBB):c.316-197C>T
  NM_000518.4(HBB):c.93-21G>A
  NM_000518.4(HBB):c.114G>A (p.Trp38Ter)
  NM_000518.4(HBB):c.118C>T (p.Gln40Ter)
  NM_000518.4(HBB):c.92+1G>A
  NM_000518.4(HBB):c.315+1G>A
  NM_000518.4(HBB):c.92+5G>A
  NM_000518.4(HBB):c.-50-101C>T See Table A. Accordingly, an aspect of the invention relates to a method for treating or preventing Beta-thalassemia by correcting one or more pathogenic G-to-A or C-to-T mutations/SNPs, particularly one or more pathogenic G-to-A or C-to-T mutations/SNPs present in the HBB gene, and more particularly one or more pathogenic G-to-A or C-to-T mutations/SNPs described above.

Hemophilia A

In some embodiments, the methods, systems, and compositions described herein are used to correct one or more pathogenic G-to-A or C-to-T mutations/SNPs associated with Hemophilia A. In some embodiment, the pathogenic mutations/SNPs are present in at least the F8 gene, including at least the followings:
  NM_000132.3(F8):c.3169G>A (p.Glu1057Lys)
  NM_000132.3(F8):c.902G>A (p.Arg301His)
  NM_000132.3(F8):c.1834C>T (p.Arg612Cys)

See Table A. Accordingly, an aspect of the invention relates to a method for treating or preventing Hemophilia A by correcting one or more pathogenic G-to-A or C-to-T mutations/SNPs, particularly one or more pathogenic G-to-A or C-to-T mutations/SNPs present in the F8 gene, and more particularly one or more pathogenic G-to-A or C-to-T mutations/SNPs described above.

Factor V Leiden

In some embodiments, the methods, systems, and compositions described herein are used to correct Factor V Leiden mutations. This disease-causing single point mutation (G1746→A) represents the most abundant genetic risk factor in heritable multifactorial thrombophilia in the Caucasian population. Due to the point mutation, a single amino acid substitution (R534[RIGHTWARDS ARROW]Q) appears at the Protein C dependent proteolytic cleavage site (R533R534) of the blood coagulation factor F5. Whereas the heterozygous defect is accompanied by an only minor increase in thrombosis risk (ca. 8-fold), the homozygous defect has a much more pronounced effect (>80-fold increased risk).19 Directed RNA editing has the potential to compensate for this genetic defect by its repair at the RNA level.

Hemophilia B

In some embodiments, the methods, systems, and compositions described herein are used to correct one or more pathogenic G-to-A or C-to-T mutations/SNPs associated with Hemophilia B. In some embodiment, the pathogenic mutations/SNPs are present in at least the F9 gene, including at least the followings:
  NM_000133.3(F9):c.835G>A (p.Ala279Thr)

See Table A. Accordingly, an aspect of the invention relates to a method for treating or preventing Hemophilia B by correcting one or more pathogenic G-to-A or C-to-T mutations/SNPs, particularly one or more pathogenic G-to-A or C-to-T mutations/SNPs present in the F9 gene, and more particularly one or more pathogenic G-to-A or C-to-T mutations/SNPs described above.

Hemophilia C

In some embodiments, the methods, systems, and compositions described herein are used to correct one or more pathogenic G-to-A or C-to-T mutations/SNPs associated with Hemophilia C. In some embodiment, the pathogenic mutations/SNPs are present in at least the F11 gene, including at least the followings:
  NM_000128.3(F11):c.400C>T (p.Gln134Ter)
  NM_000128.3(F11):c.1432G>A (p.Gly478Arg)
  NM_000128.3(F11):c.1288G>A (p.Ala430Thr)
  NM_000128.3(F11):c.326-1G>A See Table A. Accordingly, an aspect of the invention relates to a method for treating or preventing Hemophilia C by correcting one or more pathogenic G-to-A or C-to-T mutations/SNPs, particularly one or more pathogenic G-to-A or C-to-T mutations/SNPs present in the F11 gene, and more particularly one or more pathogenic G-to-A or C-to-T mutations/SNPs described above.

Wiskott-Aldrich Syndrome

In some embodiments, the methods, systems, and compositions described herein are used to correct one or more pathogenic G-to-A or C-to-T mutations/SNPs associated with Wiskott-Aldrich syndrome. In some embodiment, the pathogenic mutations/SNPs are present in at least the WAS gene, including at least the followings:

NM_000377.2(WAS):c.37C>T (p.Arg13Ter)
NM_000377.2(WAS):c.257G>A (p.Arg86His)
NM_000377.2(WAS):c.777+1G>A

See Table A. Accordingly, an aspect of the invention relates to a method for treating or preventing Wiskott-Aldrich syndrome by correcting one or more pathogenic G-to-A or C-to-T mutations/SNPs, particularly one or more pathogenic G-to-A or C-to-T mutations/SNPs present in the WAS gene, and more particularly one or more pathogenic G-to-A or C-to-T mutations/SNPs described above.

Liver Diseases

Pathogenic G-to-A or C-to-T mutations/SNPs associated with various liver diseases are reported in the ClinVar database and disclosed in Table A, including but not limited to Transthyretin amyloidosis, Alpha-1-antitrypsin deficiency, Wilson's disease, and Phenylketonuria. Accordingly, an aspect of the invention relates to a method for correcting one or more pathogenic G-to-A or C-to-T mutations/SNPs associated with any of these diseases, as discussed below.

Transthyretin Amyloidosis

In some embodiments, the methods, systems, and compositions described herein are used to correct one or more pathogenic G-to-A or C-to-T mutations/SNPs associated with Transthyretin amyloidosis. In some embodiment, the pathogenic mutations/SNPs are present in at least the TTR gene, including at least the followings:

NM_000371.3(TTR):c.424G>A (p.Val142Ile)
NM_000371.3(TTR):c.148G>A (p.Val50Met)
NM_000371.3(TTR):c.118G>A (p.Val40Ile)

See Table A. Accordingly, an aspect of the invention relates to a method for treating or preventing Transthyretin amyloidosis by correcting one or more pathogenic G-to-A or C-to-T mutations/SNPs, particularly one or more pathogenic G-to-A or C-to-T mutations/SNPs present in the TTR gene, and more particularly one or more pathogenic G-to-A or C-to-T mutations/SNPs described above.

Alpha-1-Antitrypsin Deficiency

In some embodiments, the methods, systems, and compositions described herein are used to correct one or more pathogenic G-to-A or C-to-T mutations/SNPs associated with Alpha-1-antitrypsin deficiency. In some embodiment, the pathogenic mutations/SNPs are present in at least the SERPINA1 gene, including at least the followings:

NM_000295.4(SERPINA1):c.538C>T (p.Gln180Ter)
NM_001127701.1(SERPINA1):c.1178C>T (p.Pro393Leu)
NM_001127701.1(SERPINA1):c.230C>T (p.Ser77Phe)
NM_001127701.1(SERPINA1):c.1096G>A (p.Glu366Lys)
NM_000295.4(SERPINA1):c.1177C>T (p.Pro393Ser)

See Table A. Accordingly, an aspect of the invention relates to a method for treating or preventing Alpha-1-antitrypsin deficiency by correcting one or more pathogenic G-to-A or C-to-T mutations/SNPs, particularly one or more pathogenic G-to-A or C-to-T mutations/SNPs present in the SERPINA1 gene, and more particularly one or more pathogenic G-to-A or C-to-T mutations/SNPs described above.

Wilson's Disease

In some embodiments, the methods, systems, and compositions described herein are used to correct one or more pathogenic G-to-A or C-to-T mutations/SNPs associated with Wilson's disease. In some embodiment, the pathogenic mutations/SNPs are present in at least the ATP7B gene, including at least the followings:

NM_000053.3(ATP7B):c.2293G>A (p.Asp765Asn)
NM_000053.3(ATP7B):c.3955C>T (p.Arg1319Ter)
NM_000053.3(ATP7B):c.2865+1G>A
NM_000053.3(ATP7B):c.3796G>A (p.Gly1266Arg)
NM_000053.3(ATP7B):c.2621C>T (p.Ala874Val)
NM_000053.3(ATP7B):c.2071G>A (p.Gly691Arg)
NM_000053.3(ATP7B):c.2128G>A (p.Gly710Ser)
NM_000053.3(ATP7B):c.2336G>A (p.Trp779Ter)
NM_000053.3(ATP7B):c.4021G>A (p.Gly1341Ser)
NM_000053.3(ATP7B):c.3182G>A (p.Gly1061Glu)
NM_000053.3(ATP7B):c.4114C>T (p.Gln1372Ter)
NM_000053.3(ATP7B):c.1708-1G>A
NM_000053.3(ATP7B):c.865C>T (p.Gln289Ter)
NM_000053.3(ATP7B):c.2930C>T (p.Thr977Met)
NM_000053.3(ATP7B):c.3659C>T (p.Thr1220Met)
NM_000053.3(ATP7B):c.2605G>A (p.Gly869Arg)
NM_000053.3(ATP7B):c.2975C>T (p.Pro992Leu)
NM_000053.3(ATP7B):c.2519C>T (p.Pro840Leu)
NM_000053.3(ATP7B):c.2906G>A (p.Arg969Gln)

See Table A. Accordingly, an aspect of the invention relates to a method for treating or preventing Wilson's disease by correcting one or more pathogenic G-to-A or C-to-T mutations/SNPs, particularly one or more pathogenic G-to-A or C-to-T mutations/SNPs present in the ATP7B gene, and more particularly one or more pathogenic G-to-A or C-to-T mutations/SNPs described above.

Phenylketonuria

In some embodiments, the methods, systems, and compositions described herein are used to correct one or more pathogenic G-to-A or C-to-T mutations/SNPs associated with Phenylketonuria. In some embodiment, the pathogenic mutations/SNPs are present in at least the PAH gene, including at least the followings:

NM_000277.1(PAH):c.1315+1G>A
NM_000277.1(PAH):c.1222C>T (p.Arg408Trp)
NM_000277.1(PAH):c.838G>A (p.Glu280Lys)
NM_000277.1(PAH):c.331C>T (p.Arg111Ter)
NM_000277.1(PAH):c.782G>A (p.Arg261Gln)
NM_000277.1(PAH):c.754C>T (p.Arg252Trp)
NM_000277.1(PAH):c.473G>A (p.Arg158Gln)
NM_000277.1(PAH):c.727C>T (p.Arg243Ter)
NM_000277.1(PAH):c.842C>T (p.Pro281Leu)
NM_000277.1(PAH):c.728G>A (p.Arg243Gln)
NM_000277.1(PAH): c.1066-11G>A
NM_000277.1(PAH):c.781C>T (p.Arg261Ter)
NM_000277.1(PAH):c.1223G>A (p.Arg408Gln)
NM_000277.1(PAH):c.1162G>A (p.Val388Met)
NM_000277.1(PAH):c.1066-3C>T
NM_000277.1(PAH):c.1208C>T (p.Ala403Val)
NM_000277.1(PAH):c.890G>A (p.Arg297His)
NM_000277.1(PAH):c.926C>T (p.Ala309Val)
NM_000277.1(PAH):c.441+1G>A
NM_000277.1(PAH):c.526C>T (p.Arg176Ter)
NM_000277.1(PAH):c.688G>A (p.Val230Ile)
NM_000277.1(PAH):c.721C>T (p.Arg241Cys)
NM_000277.1(PAH):c.745C>T (p.Leu249Phe)
NM_000277.1(PAH): c.442-1G>A
NM_000277.1(PAH):c.842+1G>A
NM_000277.1(PAH):c.776C>T (p.Ala259Val)
NM_000277.1(PAH):c.1200-1G>A
NM_000277.1(PAH):c.912+1G>A
NM_000277.1(PAH):c.1065+1G>A
NM_000277.1(PAH):c.472C>T (p.Arg158Trp)

NM_000277.1(PAH):c.755G>A (p.Arg252Gln)
NM_000277.1(PAH):c.809G>A (p.Arg270Lys)

See Table A. Accordingly, an aspect of the invention relates to a method for treating or preventing Phenylketonuria by correcting one or more pathogenic G-to-A or C-to-T mutations/SNPs, particularly one or more pathogenic G-to-A or C-to-T mutations/SNPs present in the PAH gene, and more particularly one or more pathogenic G-to-A or C-to-T mutations/SNPs described above.

Kidney Diseases

Pathogenic G-to-A or C-to-T mutations/SNPs associated with various kidney diseases are reported in the ClinVar database and disclosed in Table A, including but not limited to Autosomal recessive polycystic kidney disease and Renal carnitine transport defect. Accordingly, an aspect of the invention relates to a method for correcting one or more pathogenic G-to-A or C-to-T mutations/SNPs associated with any of these diseases, as discussed below.

Autosomal Recessive Polycystic Kidney Disease

In some embodiments, the methods, systems, and compositions described herein are used to correct one or more pathogenic G-to-A or C-to-T mutations/SNPs associated with Autosomal recessive polycystic kidney disease. In some embodiment, the pathogenic mutations/SNPs are present in at least the PKHD1 gene, including at least the followings:
  NM_138694.3(PKHD1):c.10444C>T (p.Arg3482Cys)
  NM_138694.3(PKHD1):c.9319C>T (p.Arg3107Ter)
  NM_138694.3(PKHD1):c.1480C>T (p.Arg494Ter)
  NM_138694.3(PKHD1): c.707+1G>A
  NM_138694.3(PKHD1):c.1486C>T (p.Arg496Ter)
  NM_138694.3(PKHD1): c.8303-1G>A
  NM_138694.3(PKHD1):c.2854G>A (p.Gly952Arg)
  NM_138694.3(PKHD1):c.7194G>A (p.Trp2398Ter)
  NM_138694.3(PKHD1):c.10219C>T (p.Gln3407Ter)
  NM_138694.3(PKHD1):c.107C>T (p.Thr36Met)
  NM_138694.3(PKHD1):c.8824C>T (p.Arg2942Ter)
  NM_138694.3(PKHD1):c.982C>T (p.Arg328Ter)
  NM_138694.3(PKHD1):c.4870C>T (p.Arg1624Trp)
  NM_138694.3(PKHD1): c.1602+1G>A
  NM_138694.3(PKHD1): c.1694-1G>A
  NM_138694.3(PKHD1):c.2341C>T (p.Arg781Ter)
  NM_138694.3(PKHD1): c.2407+1G>A
  NM_138694.3(PKHD1):c.2452C>T (p.Gln818Ter)
  NM_138694.3(PKHD1): c.5236+1G>A
  NM_138694.3(PKHD1):c.6499C>T (p.Gln2167Ter)
  NM_138694.3(PKHD1):c.2725C>T (p.Arg909Ter)
  NM_138694.3(PKHD1):c.370C>T (p.Arg124Ter)
  NM_138694.3(PKHD1):c.2810G>A (p.Trp937Ter)

See Table A. Accordingly, an aspect of the invention relates to a method for treating or preventing Autosomal recessive polycystic kidney disease by correcting one or more pathogenic G-to-A or C-to-T mutations/SNPs, particularly one or more pathogenic G-to-A or C-to-T mutations/SNPs present in the PKHD1 gene, and more particularly one or more pathogenic G-to-A or C-to-T mutations/SNPs described above.

Renal Carnitine Transport Defect

In some embodiments, the methods, systems, and compositions described herein are used to correct one or more pathogenic G-to-A or C-to-T mutations/SNPs associated with Renal carnitine transport defect. In some embodiment, the pathogenic mutations/SNPs are present in at least the SLC22A5 gene, including at least the followings:
  NM_003060.3(SLC22A5):c.760C>T (p.Arg254Ter)
  NM_003060.3(SLC22A5):c.396G>A (p.Trp132Ter)
  NM_003060.3(SLC22A5):c.844C>T (p.Arg282Ter)
  NM_003060.3(SLC22A5):c.505C>T (p.Arg169Trp)
  NM_003060.3(SLC22A5):c.1319C>T (p.Thr440Met)
  NM_003060.3(SLC22A5):c.1195C>T (p.Arg399Trp)
  NM_003060.3(SLC22A5):c.695C>T (p.Thr232Met)
  NM_003060.3(SLC22A5):c.845G>A (p.Arg282Gln)
  NM_003060.3(SLC22A5):c. 1193C>T (p.Pro398Leu)
  NM_003060.3(SLC22A5):c.1463G>A (p.Arg488His)
  NM_003060.3(SLC22A5):c.338G>A (p.Cys113Tyr)
  NM_003060.3(SLC22A5):c.136C>T (p.Pro46Ser)
  NM_003060.3(SLC22A5):c.506G>A (p.Arg169Gln)

See Table A. Accordingly, an aspect of the invention relates to a method for treating or preventing Renal carnitine transport defect by correcting one or more pathogenic G-to-A or C-to-T mutations/SNPs, particularly one or more pathogenic G-to-A or C-to-T mutations/SNPs present in the SLC22A5 gene, and more particularly one or more pathogenic G-to-A or C-to-T mutations/SNPs described above.

Muscle Diseases

Pathogenic G-to-A or C-to-T mutations/SNPs associated with various muscle diseases are reported in the ClinVar database and disclosed in Table A, including but not limited to Duchenne muscular dystrophy, Becker muscular dystrophy, Limb-girdle muscular dystrophy, Emery-Dreifuss muscular dystrophy, and Facioscapulohumeral muscular dystrophy. Accordingly, an aspect of the invention relates to a method for correcting one or more pathogenic G-to-A or C-to-T mutations/SNPs associated with any of these diseases, as discussed below.

Duchenne Muscular Dystrophy

In some embodiments, the methods, systems, and compositions described herein are used to correct one or more pathogenic G-to-A or C-to-T mutations/SNPs associated with Duchenne muscular dystrophy. In some embodiment, the pathogenic mutations/SNPs are present in at least the DMD gene, including at least the followings:
  NM_004006.2(DMD):c.2797C>T (p.Gln933Ter)
  NM_004006.2(DMD):c.4870C>T (p.Gln1624Ter)
  NM_004006.2(DMD):c.5551C>T (p.Gln1851Ter)
  NM_004006.2(DMD):c.3188G>A (p.Trp1063Ter)
  NM_004006.2(DMD):c.8357G>A (p.Trp2786Ter)
  NM_004006.2(DMD):c.7817G>A (p.Trp2606Ter)
  NM_004006.2(DMD):c.7755G>A (p.Trp2585Ter)
  NM_004006.2(DMD):c.5917C>T (p.Gln1973Ter)
  NM_004006.2(DMD):c.5641C>T (p.Gln1881Ter)
  NM_004006.2(DMD):c.5131C>T (p.Gln1711Ter)
  NM_004006.2(DMD):c.4240C>T (p.Gln1414Ter)
  NM_004006.2(DMD):c.3427C>T (p.Gln1143Ter)
  NM_004006.2(DMD):c.2407C>T (p.Gln803Ter)
  NM_004006.2(DMD):c.2368C>T (p.Gln790Ter)
  NM_004006.2(DMD):c.1683G>A (p.Trp561Ter)
  NM_004006.2(DMD):c.1663C>T (p.Gln555Ter)
  NM_004006.2(DMD):c.1388G>A (p. Trp463 Ter)
  NM_004006.2(DMD):c.1331+1G>A
  NM_004006.2(DMD):c.1324C>T (p.Gln442Ter)
  NM_004006.2(DMD):c.355C>T (p.Gln119Ter)
  NM_004006.2(DMD): c.94-1G>A
  NM_004006.2(DMD):c.5506C>T (p.Gln1836Ter)
  NM_004006.2(DMD):c.1504C>T (p.Gln502Ter)
  NM_004006.2(DMD):c.5032C>T (p.Gln1678Ter)
  NM_004006.2(DMD):c.457C>T (p.Gln153Ter)
  NM_004006.2(DMD):c.1594C>T (p.Gln532Ter)
  NM_004006.2(DMD):c.1150-1G>A
  NM_004006.2(DMD):c.6223C>T (p.Gln2075Ter)
  NM_004006.2(DMD):c.3747G>A (p. Trp1249Ter)
  NM_004006.2(DMD):c.2861G>A (p.Trp954Ter)
  NM_004006.2(DMD):c.9563+1G>A
  NM_004006.2(DMD):c.4483C>T (p.Gln1495Ter)

NM_004006.2(DMD):c.4312C>T (p.Gln1438Ter)
NM_004006.2(DMD):c.8209C>T (p.Gln2737Ter)
NM_004006.2(DMD): c.4071+1G>A
NM_004006.2(DMD):c.2665C>T (p.Arg889Ter)
NM_004006.2(DMD):c.2202G>A (p.Trp734Ter)
NM_004006.2(DMD):c.2077C>T (p.Gln693Ter)
NM_004006.2(DMD):c.1653G>A (p.Trp551Ter)
NM_004006.2(DMD):c.1061G>A (p.Trp354Ter)
NM_004006.2(DMD):c.8914C>T (p.Gln2972Ter)
NM_004006.2(DMD):c.6118-1G>A
NM_004006.2(DMD):c.4729C>T (p.Arg1577Ter)

See Table A. Accordingly, an aspect of the invention relates to a method for treating or preventing Duchenne muscular dystrophy by correcting one or more pathogenic G-to-A or C-to-T mutations/SNPs, particularly one or more pathogenic G-to-A or C-to-T mutations/SNPs present in the DMD gene, and more particularly one or more pathogenic G-to-A or C-to-T mutations/SNPs described above.

Becker Muscular Dystrophy

In some embodiments, the methods, systems, and compositions described herein are used to correct one or more pathogenic G-to-A or C-to-T mutations/SNPs associated with Becker muscular dystrophy. In some embodiment, the pathogenic mutations/SNPs are present in at least the DMD gene, including at least the followings:

NM_004006.2(DMD):c.3413G>A (p.Trp1138Ter)
NM_004006.2(DMD):c.358-1G>A
NM_004006.2(DMD):c.10108C>T (p.Arg3370Ter)
NM_004006.2(DMD):c.6373C>T (p.Gln2125Ter)
NM_004006.2(DMD):c.9568C>T (p.Arg3190Ter)
NM_004006.2(DMD):c.8713C>T (p.Arg2905Ter)
NM_004006.2(DMD):c.1615C>T (p.Arg539Ter)
NM_004006.2(DMD):c.3151C>T (p.Arg1051Ter)
NM_004006.2(DMD): c.3432+1G>A
NM_004006.2(DMD):c.5287C>T (p.Arg1763Ter)
NM_004006.2(DMD):c.5530C>T (p.Arg1844Ter)
NM_004006.2(DMD):c.8608C>T (p.Arg2870Ter)
NM_004006.2(DMD):c.8656C>T (p.Gln2886Ter)
NM_004006.2(DMD):c.8944C>T (p.Arg2982Ter)
NM_004006.2(DMD):c.5899C>T (p.Arg1967Ter)
NM_004006.2(DMD):c.10033C>T (p.Arg3345Ter)
NM_004006.2(DMD):c.10086+1G>A
NM_004019.2(DMD):c.1020G>A (p.Thr340=)
NM_004006.2(DMD):c.1261C>T (p.Gln421Ter)
NM_004006.2(DMD):c.1465C>T (p.Gln489Ter)
NM_004006.2(DMD):c.1990C>T (p.Gln664Ter)
NM_004006.2(DMD):c.2032C>T (p.Gln678Ter)
NM_004006.2(DMD):c.2332C>T (p.Gln778Ter)
NM_004006.2(DMD):c.2419C>T (p.Gln807Ter)
NM_004006.2(DMD):c.2650C>T (p.Gln884Ter)
NM_004006.2(DMD):c.2804-1G>A
NM_004006.2(DMD): c.3276+1G>A
NM_004006.2(DMD):c.3295C>T (p.Gln1099Ter)
NM_004006.2(DMD):c.336G>A (p.Trp112Ter)
NM_004006.2(DMD):c.3580C>T (p.Gln1194Ter)
NM_004006.2(DMD):c.4117C>T (p.Gln1373Ter)
NM_004006.2(DMD): c.649+1G>A
NM_004006.2(DMD):c.6906G>A (p. Trp2302Ter)
NM_004006.2(DMD):c.7189C>T (p.Gln2397Ter)
NM_004006.2(DMD): c.7309+1G>A
NM_004006.2(DMD):c.7657C>T (p.Arg2553Ter)
NM_004006.2(DMD):c.7682G>A (p.Trp2561Ter)
NM_004006.2(DMD):c.7683G>A (p.Trp2561Ter)
NM_004006.2(DMD):c.7894C>T (p.Gln2632Ter)
NM_004006.2(DMD): c.9361+1G>A
NM_004006.2(DMD):c.9564-1G>A
NM_004006.2(DMD):c.2956C>T (p.Gln986Ter)
NM_004006.2(DMD):c.883C>T (p.Arg295Ter)
NM_004006.2(DMD): c.31+36947G>A
NM_004006.2(DMD):c.10279C>T (p.Gln3427Ter)
NM_004006.2(DMD):c.433C>T (p.Arg145Ter)
NM_004006.2(DMD):c.9G>A (p.Trp3Ter)
NM_004006.2(DMD):c.10171C>T (p.Arg3391Ter)
NM_004006.2(DMD):c.583C>T (p.Arg195Ter)
NM_004006.2(DMD):c.9337C>T (p.Arg3113Ter)
NM_004006.2(DMD):c.8038C>T (p.Arg2680Ter)
NM_004006.2(DMD): c.1812+1G>A
NM_004006.2(DMD):c.1093C>T (p.Gln365Ter)
NM_004006.2(DMD): c.1704+1G>A
NM_004006.2(DMD):c.1912C>T (p.Gln638Ter)
NM_004006.2(DMD):c.133C>T (p.Gln45Ter)
NM_004006.2(DMD):c.5868G>A (p.Trp1956Ter)
NM_004006.2(DMD):c.565C>T (p.Gln189Ter)
NM_004006.2(DMD):c.5089C>T (p.Gln1697Ter)
NM_004006.2(DMD):c.2512C>T (p.Gln838Ter)
NM_004006.2(DMD):c.10477C>T (p.Gln3493Ter)
NM_004006.2(DMD): c.93+1G>A
NM_004006.2(DMD):c.4174C>T (p.Gln1392Ter)
NM_004006.2(DMD):c.3940C>T (p.Arg1314Ter)

See Table A. Accordingly, an aspect of the invention relates to a method for treating or preventing Becker muscular dystrophy by correcting one or more pathogenic G-to-A or C-to-T mutations/SNPs, particularly one or more pathogenic G-to-A or C-to-T mutations/SNPs present in the DMD gene, and more particularly one or more pathogenic G-to-A or C-to-T mutations/SNPs described above.

Limb-Girdle Muscular Dystrophy

In some embodiments, the methods, systems, and compositions described herein are used to correct one or more pathogenic G-to-A or C-to-T mutations/SNPs associated with Limb-girdle muscular dystrophy. In some embodiment, the pathogenic mutations/SNPs are present in at least one gene selected from SGCB, MYOT, LMNA, CAPN3, DYSF, SGCA, TTN, ANO5, TRAPPC11, LMNA, POMT1, and FKRP, including at least the followings:

NM_000232.4(SGCB):c.31C>T (p.Gln11Ter)
NM_006790.2(MYOT):c.164C>T (p.Ser55Phe)
NM_006790.2(MYOT):c.170C>T (p.Thr57Ile)
NM_170707.3(LMNA):c.1488+1G>A
NM_170707.3(LMNA):c.1609-1G>A
NM_000070.2(CAPN3):c.1715G>A (p.Arg572Gln)
NM_000070.2(CAPN3):c.2243G>A (p.Arg748Gln)
NM_000070.2(CAPN3):c.145C>T (p.Arg49Cys)
NM_000070.2(CAPN3):c.1319G>A (p.Arg440Gln)
NM_000070.2(CAPN3):c.1343G>A (p.Arg448His)
NM_000070.2(CAPN3):c.1465C>T (p.Arg489Trp)
NM_000070.2(CAPN3):c.1714C>T (p.Arg572Trp)
NM_000070.2(CAPN3):c.2306G>A (p.Arg769Gln)
NM_000070.2(CAPN3):c.133G>A (p.Ala45Thr)
NM_000070.2(CAPN3):c.499-1G>A
NM_000070.2(CAPN3):c.439C>T (p.Arg147Ter)
NM_000070.2(CAPN3):c.1063C>T (p.Arg355Trp)
NM_000070.2(CAPN3):c.1250C>T (p.Thr417Met)
NM_000070.2(CAPN3):c.245C>T (p.Pro82Leu)
NM_000070.2(CAPN3):c.2242C>T (p.Arg748Ter)
NM_000070.2(CAPN3):c.1318C>T (p.Arg440Trp)
NM_000070.2(CAPN3):c.1333G>A (p.Gly445Arg)
NM_000070.2(CAPN3):c.1957C>T (p.Gln653Ter)
NM_000070.2(CAPN3): c.1801-1G>A
NM_000070.2(CAPN3): c.2263+1G>A
NM_000070.2(CAPN3):c.956C>T (p.Pro319Leu)
NM_000070.2(CAPN3): c.1468C>T (p.Arg490Trp)
NM_000070.2(CAPN3):c.802-9G>A

NM_000070.2(CAPN3):c.1342C>T (p.Arg448Cys)
NM_000070.2(CAPN3):c.1303G>A (p.Glu435Lys)
NM_000070.2(CAPN3):c.1993-1G>A
NM_003494.3(DYSF):c.3113G>A (p.Arg1038Gln)
NM_001130987.1(DYSF):c.5174+1G>A
NM_001130987.1(DYSF):c.159G>A (p.Trp53Ter)
NM_001130987.1(DYSF):c.2929C>T (p.Arg977Trp)
NM_001130987.1(DYSF):c.4282C>T (p.Gln1428Ter)
NM_001130987.1(DYSF):c.1577-1G>A
NM_003494.3(DYSF):c.5529G>A (p.Trp1843Ter)
NM_001130987.1(DYSF):c.1576+1G>A
NM_001130987.1(DYSF):c.4462C>T (p.Gln1488Ter)
NM_003494.3(DYSF):c.5429G>A (p.Arg1810Lys)
NM_003494.3(DYSF):c.5077C>T (p.Arg1693Trp)
NM_001130978.1(DYSF):c.1813C>T (p.Gln605Ter)
NM_003494.3(DYSF):c.3230G>A (p.Trp1077Ter)
NM_003494.3(DYSF):c.265C>T (p.Arg89Ter)
NM_003494.3(DYSF):c.4434G>A (p.Trp1478Ter)
NM_003494.3(DYSF):c.3478C>T (p.Gln1160Ter)
NM_001130987.1(DYSF):c.1372G>A (p.Gly458Arg)
NM_003494.3(DYSF):c.4090C>T (p.Gln1364Ter)
NM_001130987.1(DYSF):c.2409+1G>A
NM_003494.3(DYSF):c.1708C>T (p.Gln570Ter)
NM_003494.3(DYSF):c.1956G>A (p.Trp652Ter)
NM_001130987.1(DYSF):c.5004-1G>A
NM_003494.3(DYSF):c.331C>T (p.Gln111Ter)
NM_001130978.1(DYSF):c.5776C>T (p.Arg1926Ter)
NM_003494.3(DYSF):c.6124C>T (p.Arg2042Cys)
NM_003494.3(DYSF):c.2643+1G>A
NM_003494.3(DYSF):c.4253G>A (p.Gly1418Asp)
NM_003494.3(DYSF):c.610C>T (p.Arg204Ter)
NM_003494.3(DYSF):c.1834C>T (p.Gln612Ter)
NM_003494.3(DYSF):c.5668-7G>A
NM_001130978.1(DYSF):c.3137G>A (p.Arg1046His)
NM_003494.3(DYSF):c.1053+1G>A
NM_003494.3(DYSF):c.1398-1G>A
NM_003494.3(DYSF):c.1481-1G>A
NM_003494.3(DYSF):c.2311C>T (p.Gln771Ter)
NM_003494.3(DYSF):c.2869C>T (p.Gln957Ter)
NM_003494.3(DYSF):c.4756C>T (p.Arg1586Ter)
NM_003494.3(DYSF):c.5509G>A (p.Asp1837Asn)
NM_003494.3(DYSF):c.5644C>T (p.Gln1882Ter)
NM_003494.3(DYSF):c.5946+1G>A
NM_003494.3(DYSF):c.937+1G>A
NM_003494.3(DYSF):c.5266C>T (p.Gln1756Ter)
NM_003494.3(DYSF):c.3832C>T (p.Gln1278Ter)
NM_003494.3(DYSF):c.5525+1G>A
NM_003494.3(DYSF):c.3112C>T (p.Arg1038Ter)
NM_000023.3(SGCA):c.293G>A (p.Arg98His)
NM_000023.3(SGCA):c.850C>T (p.Arg284Cys)
NM_000023.3(SGCA):c.403C>T (p.Gln135Ter)
NM_000023.3(SGCA):c.409G>A (p.Glu137Lys)
NM_000023.3(SGCA): c.747+1G>A
NM_000023.3(SGCA):c.229C>T (p.Arg77Cys)
NM_000023.3(SGCA):c.101G>A (p.Arg34His)
NM_000023.3(SGCA):c.739G>A (p.Val247Met)
NM_001256850.1(TTN):c.87394C>T (p.Arg29132Ter)
NM_213599.2(ANO5):c.762+1G>A
NM_213599.2(ANO5):c.1213C>T (p.Gln405Ter)
NM_213599.2(ANO5):c.1639C>T (p.Arg547Ter)
NM_213599.2(ANO5):c.1406G>A (p.Trp469Ter)
NM_213599.2(ANO5):c.1210C>T (p.Arg404Ter)
NM_213599.2(ANO5):c.2272C>T (p.Arg758Cys)
NM_213599.2(ANO5):c.41-1G>A
NM_213599.2(ANO5):c.172C>T (p.Arg58Trp)
NM_213599.2(ANO5):c.1898+1G>A
NM_021942.5(TRAPPC11): c.1287+5G>A
NM_170707.3(LMNA): c.1608+1G>A
NM_007171.3(POMT1):c.1864C>T (p.Arg622Ter)
NM_024301.4(FKRP):c.313C>T (p.Gln105Ter)

See Table A. Accordingly, an aspect of the invention relates to a method for treating or preventing Limb-girdle muscular dystrophy by correcting one or more pathogenic G-to-A or C-to-T mutations/SNPs, particularly one or more pathogenic G-to-A or C-to-T mutations/SNPs present in at least one gene selected from SGCB, MYOT, LMNA, CAPN3, DYSF, SGCA, TTN, ANO5, TRAPPC11, LMNA, POMT1, and FKRP, and more particularly one or more pathogenic G-to-A or C-to-T mutations/SNPs described above.

Emery-Dreifuss Muscular Dystrophy

In some embodiments, the methods, systems, and compositions described herein are used to correct one or more pathogenic G-to-A or C-to-T mutations/SNPs associated with Emery-Dreifuss muscular dystrophy. In some embodiment, the pathogenic mutations/SNPs are present in at least the EMD or SYNE1 gene, including at least the followings:
NM_000117.2(EMD):c.3G>A (p.Met1Ile)
NM_033071.3(SYNE1):c.11908C>T (p.Arg3970Ter)
NM_033071.3(SYNE1):c.21721C>T (p.Gln7241Ter)
NM_000117.2(EMD):c.130C>T (p.Gln44Ter)

See Table A. Accordingly, an aspect of the invention relates to a method for treating or preventing Emery-Dreifuss muscular dystrophy by correcting one or more pathogenic G-to-A or C-to-T mutations/SNPs, particularly one or more pathogenic G-to-A or C-to-T mutations/SNPs present in the EMD or SYNE1 gene, and more particularly one or more pathogenic G-to-A or C-to-T mutations/SNPs described above.

Facioscapulohumeral Muscular Dystrophy

In some embodiments, the methods, systems, and compositions described herein are used to correct one or more pathogenic G-to-A or C-to-T mutations/SNPs associated with Facioscapulohumeral muscular dystrophy. In some embodiment, the pathogenic mutations/SNPs are present in at least the SMCHD1 gene, including at least the followings:
NM_015295.2(SMCHD1):c.3801+1G>A
NM_015295.2(SMCHD1):c.1843-1G>A See Table A. Accordingly, an aspect of the invention relates to a method for treating or preventing Facioscapulohumeral muscular dystrophy by correcting one or more pathogenic G-to-A or C-to-T mutations/SNPs, particularly one or more pathogenic G-to-A or C-to-T mutations/SNPs present in the SMCHD1 gene, and more particularly one or more pathogenic G-to-A or C-to-T mutations/SNPs described above.

Inborn Errors of Metabolism (IEM)

Pathogenic G-to-A or C-to-T mutations/SNPs associated with various IEMs are reported in the ClinVar database and disclosed in Table A, including but not limited to Primary hyperoxaluria type 1, Argininosuccinate lyase deficiency, Ornithine carbamoyltransferase deficiency, and Maple syrup urine disease. Accordingly, an aspect of the invention relates to a method for correcting one or more pathogenic G-to-A or C-to-T mutations/SNPs associated with any of these diseases, as discussed below.

Primary Hyperoxaluria Type 1

In some embodiments, the methods, systems, and compositions described herein are used to correct one or more pathogenic G-to-A or C-to-T mutations/SNPs associated with Primary hyperoxaluria type 1. In some embodiment, the pathogenic mutations/SNPs are present in at least the AGXT gene, including at least the followings:

NM_000030.2(AGXT):c.245G>A (p.Gly82Glu)
NM_000030.2(AGXT):c.698G>A (p.Arg233His)
NM_000030.2(AGXT):c.466G>A (p.Gly156Arg)
NM_000030.2(AGXT):c.106C>T (p.Arg36Cys)
NM_000030.2(AGXT):c.346G>A (p.Gly116Arg)
NM_000030.2(AGXT):c.568G>A (p.Gly190Arg)
NM_000030.2(AGXT):c.653C>T (p.Ser218Leu)
NM_000030.2(AGXT):c.737G>A (p.Trp246Ter)
NM_000030.2(AGXT):c.1049G>A (p.Gly350Asp)
NM_000030.2(AGXT):c.473C>T (p.Ser158Leu)
NM_000030.2(AGXT):c.907C>T (p.Gln303Ter)
NM_000030.2(AGXT):c.996G>A (p.Trp332Ter)
NM_000030.2(AGXT):c.508G>A (p.Gly170Arg)

See Table A. Accordingly, an aspect of the invention relates to a method for treating or preventing Primary hyperoxaluria type 1 by correcting one or more pathogenic G-to-A or C-to-T mutations/SNPs, particularly one or more pathogenic G-to-A or C-to-T mutations/SNPs present in the AGXT gene, and more particularly one or more pathogenic G-to-A or C-to-T mutations/SNPs described above.

Argininosuccinate Lyase Deficiency

In some embodiments, the methods, systems, and compositions described herein are used to correct one or more pathogenic G-to-A or C-to-T mutations/SNPs associated with Argininosuccinate lyase deficiency. In some embodiment, the pathogenic mutations/SNPs are present in at least the ASL gene, including at least the followings:
NM_001024943.1(ASL):c.1153C>T (p.Arg385Cys)
NM_000048.3(ASL):c.532G>A (p.Val178Met)
NM_000048.3(ASL):c.545G>A (p.Arg182Gln)
NM_000048.3(ASL):c.175G>A (p.Glu59Lys)
NM_000048.3(ASL):c.718+5G>A
NM_000048.3(ASL):c.889C>T (p.Arg297Trp)
NM_000048.3(ASL):c.1360C>T (p.Gln454Ter)
NM_000048.3(ASL):c.1060C>T (p.Gln354Ter)
NM_000048.3(ASL):c.35G>A (p.Arg12Gln)
NM_000048.3(ASL):c.446+1G>A
NM_000048.3(ASL):c.544C>T (p.Arg182Ter)
NM_000048.3(ASL):c.1135C>T (p.Arg379Cys)

See Table A. Accordingly, an aspect of the invention relates to a method for treating or preventing Argininosuccinate lyase deficiency by correcting one or more pathogenic G-to-A or C-to-T mutations/SNPs, particularly one or more pathogenic G-to-A or C-to-T mutations/SNPs present in the ASL gene, and more particularly one or more pathogenic G-to-A or C-to-T mutations/SNPs described above.

Ornithine Carbamoyltransferase Deficiency

In some embodiments, the methods, systems, and compositions described herein are used to correct one or more pathogenic G-to-A or C-to-T mutations/SNPs associated with Ornithine carbamoyltransferase deficiency. In some embodiment, the pathogenic mutations/SNPs are present in at least the OTC gene, including at least the followings:
NM_000531.5(OTC):c.119G>A (p.Arg40His)
NM_000531.5(OTC):c.422G>A (p.Arg141Gln)
NM_000531.5(OTC):c.829C>T (p.Arg277Trp)
NM_000531.5(OTC):c.674C>T (p.Pro225Leu)

See Table A. Accordingly, an aspect of the invention relates to a method for treating or preventing Ornithine carbamoyltransferase deficiency by correcting one or more pathogenic G-to-A or C-to-T mutations/SNPs, particularly one or more pathogenic G-to-A or C-to-T mutations/SNPs present in the OTC gene, and more particularly one or more pathogenic G-to-A or C-to-T mutations/SNPs described above.

Maple Syrup Urine Disease

In some embodiments, the methods, systems, and compositions described herein are used to correct one or more pathogenic G-to-A or C-to-T mutations/SNPs associated with Maple syrup urine disease. In some embodiment, the pathogenic mutations/SNPs are present in at least one gene selected from BCKDHA, BCKDHB, DBT, and DLD, including at least the followings:
NM_000709.3(BCKDHA):c.476G>A (p.Arg159Gln)
NM_183050.3(BCKDHB):c.3G>A (p.Met1Ile)
NM_183050.3(BCKDHB):c.554C>T (p.Pro185Leu)
NM_001918.3(DBT):c.1033G>A (p.Gly345Arg)
NM_000709.3(BCKDHA):c.940C>T (p.Arg314Ter)
NM_000709.3(BCKDHA):c.793C>T (p.Arg265Trp)
NM_000709.3(BCKDHA):c.868G>A (p.Gly290Arg)
NM_000108.4(DLD):c.1123G>A (p.Glu375Lys)
NM_000709.3(BCKDHA):c.1234G>A (p.Val412Met)
NM_000709.3(BCKDHA): c.288+1G>A
NM_000709.3(BCKDHA):c.979G>A (p.Glu327Lys)
NM_001918.3(DBT):c.901C>T (p.Arg301Cys)
NM_183050.3(BCKDHB):c.509G>A (p.Arg170His)
NM_183050.3(BCKDHB):c.799C>T (p.Gln267Ter)
NM_183050.3(BCKDHB):c.853C>T (p.Arg285Ter)
NM_183050.3(BCKDHB):c.970C>T (p.Arg324Ter)
NM_183050.3(BCKDHB):c.832G>A (p.Gly278Ser)
NM_000709.3(BCKDHA):c.1036C>T (p.Arg346Cys)
NM_000709.3(BCKDHA): c.288+9C>T
NM_000709.3(BCKDHA):c.632C>T (p.Thr211Met)
NM_000709.3(BCKDHA):c.659C>T (p.Ala220Val)
NM_000709.3(BCKDHA):c.964C>T (p.Gln322Ter)
NM_001918.3(DBT):c.1291C>T (p.Arg431Ter)
NM_001918.3(DBT):c.251G>A (p.Trp84Ter)
NM_001918.3(DBT):c.871C>T (p.Arg291Ter)
NM_000056.4(BCKDHB):c.1016C>T (p.Ser339Leu)
NM_000056.4(BCKDHB):c.344-1G>A
NM_000056.4(BCKDHB):c.633+1G>A
NM_000056.4(BCKDHB):c.952-1G>A See Table A. Accordingly, an aspect of the invention relates to a method for treating or preventing Maple syrup urine disease by correcting one or more pathogenic G-to-A or C-to-T mutations/SNPs, particularly one or more pathogenic G-to-A or C-to-T mutations/SNPs present in at least one gene selected from BCKDHA, BCKDHB, DBT, and DLD, and more particularly one or more pathogenic G-to-A or C-to-T mutations/SNPs described above.

Cancer-Related Diseases

Pathogenic G-to-A or C-to-T mutations/SNPs associated with various cancers and cancer-related diseases are reported in the ClinVar database and disclosed in Table A, including but not limited to Breast-Ovarian Cancer and Lynch syndrome. Accordingly, an aspect of the invention relates to a method for correcting one or more pathogenic G-to-A or C-to-T mutations/SNPs associated with any of these diseases, as discussed below.

Breast-Ovarian Cancer

In some embodiments, the methods, systems, and compositions described herein are used to correct one or more pathogenic G-to-A or C-to-T mutations/SNPs associated with Breast-Ovarian Cancer. In some embodiment, the pathogenic mutations/SNPs are present in at least the BRCA1 or BRCA2 gene, including at least the followings:
NM_007294.3(BRCA1):c.5095C>T (p.Arg1699Trp)
NM_000059.3(BRCA2):c.7558C>T (p.Arg2520Ter)
NM_007294.3(BRCA1):c.2572C>T (p.Gln858Ter)
NM_007294.3(BRCA1):c.3607C>T (p.Arg1203Ter)
NM_007294.3(BRCA1):c.5503C>T (p.Arg1835Ter)
NM_007294.3(BRCA1):c.2059C>T (p.Gln687Ter)
NM_007294.3(BRCA1):c.4675+1G>A NM_007294.3(BRCA1):c.5251C>T (p.Arg1751Ter)
NM_007294.3(BRCA1):c.5444G>A (p.Trp1815Ter)
NM_000059.3(BRCA2):c.9318G>A (p.Trp3106Ter)
NM_000059.3(BRCA2):c.9382C>T (p.Arg3128Ter)
NM_000059.3(BRCA2):c.274C>T (p.Gln92Ter)
NM_000059.3(BRCA2):c.6952C>T (p.Arg2318Ter)
NM_007294.3(BRCA1):c.1687C>T (p.Gln563Ter)
NM_007294.3(BRCA1):c.2599C>T (p.Gln867Ter)
NM_007294.3(BRCA1):c.784C>T (p.Gln262Ter)
NM_007294.3(BRCA1):c.280C>T (p.Gln94Ter)
NM_007294.3(BRCA1):c.5542C>T (p.Gln1848Ter)
NM_007294.3(BRCA1):c.5161C>T (p.Gln1721Ter)
NM_007294.3(BRCA1):c.4573C>T (p.Gln1525Ter)
NM_007294.3(BRCA1):c.4270C>T (p.Gln1424Ter)
NM_007294.3(BRCA1):c.4225C>T (p.Gln1409Ter)
NM_007294.3(BRCA1):c.4066C>T (p.Gln1356Ter)
NM_007294.3(BRCA1):c.3679C>T (p.Gln1227Ter)
NM_007294.3(BRCA1):c.1918C>T (p.Gln640Ter)
NM_007294.3(BRCA1):c.963G>A (p.Trp321Ter)
NM_007294.3(BRCA1):c.718C>T (p.Gln240Ter)
NM_000059.3(BRCA2):c.9196C>T (p.Gln3066Ter)
NM_000059.3(BRCA2):c.9154C>T (p.Arg3052Trp)
NM_007294.3(BRCA1):c.3991C>T (p.Gln1331Ter)
NM_007294.3(BRCA1): c.4097-1G>A
NM_007294.3(BRCA1):c.1059G>A (p.Trp353Ter)
NM_007294.3(BRCA1):c.1115G>A (p.Trp372Ter)
NM_007294.3(BRCA1):c.1138C>T (p.Gln380Ter)
NM_007294.3(BRCA1):c.1612C>T (p.Gln538Ter)
NM_007294.3(BRCA1):c.1621C>T (p.Gln541Ter)
NM_007294.3(BRCA1):c.1630C>T (p.Gln544Ter)
NM_007294.3(BRCA1):c.178C>T (p.Gln60Ter)
NM_007294.3(BRCA1):c.1969C>T (p.Gln657Ter)
NM_007294.3(BRCA1):c.2275C>T (p.Gln759Ter)
NM_007294.3(BRCA1):c.2410C>T (p.Gln804Ter)
NM_007294.3(BRCA1):c.2869C>T (p.Gln957Ter)
NM_007294.3(BRCA1):c.2923C>T (p.Gln975Ter)
NM_007294.3(BRCA1):c.3268C>T (p.Gln1090Ter)
NM_007294.3(BRCA1):c.3430C>T (p.Gln1144Ter)
NM_007294.3(BRCA1):c.3544C>T (p.Gln1182Ter)
NM_007294.3(BRCA1):c.4075C>T (p.Gln1359Ter)
NM_007294.3(BRCA1):c.4201C>T (p.Gln1401Ter)
NM_007294.3(BRCA1):c.4399C>T (p.Gln1467Ter)
NM_007294.3(BRCA1):c.4552C>T (p.Gln1518Ter)
NM_007294.3(BRCA1):c.5054C>T (p.Thr1685Ile)
NM_007294.3(BRCA1):c.514C>T (p.Gln172Ter)
NM_007294.3(BRCA1):c.5239C>T (p.Gln1747Ter)
NM_007294.3(BRCA1):c.5266C>T (p.Gln1756Ter)
NM_007294.3(BRCA1):c.5335C>T (p.Gln1779Ter)
NM_007294.3(BRCA1):c.5345G>A (p.Trp1782Ter)
NM_007294.3(BRCA1):c.5511G>A (p.Trp1837Ter)
NM_007294.3(BRCA1):c.5536C>T (p.Gln1846Ter)
NM_007294.3(BRCA1):c.55C>T (p.Gln19Ter)
NM_007294.3(BRCA1):c.949C>T (p.Gln317Ter)
NM_007294.3(BRCA1):c.928C>T (p.Gln310Ter)
NM_007294.3(BRCA1):c.5117G>A (p.Gly1706Glu)
NM_007294.3(BRCA1):c.5136G>A (p.Trp1712Ter)
NM_007294.3(BRCA1):c.4327C>T (p.Arg1443Ter)
NM_007294.3(BRCA1):c.1471C>T (p.Gln491Ter)
NM_007294.3(BRCA1):c.1576C>T (p.Gln526Ter)
NM_007294.3(BRCA1):c.160C>T (p.Gln54Ter)
NM_007294.3(BRCA1):c.2683C>T (p.Gln895Ter)
NM_007294.3(BRCA1):c.2761C>T (p.Gln921Ter)
NM_007294.3(BRCA1):c.3895C>T (p.Gln1299Ter)
NM_007294.3(BRCA1):c.4339C>T (p.Gln1447Ter)
NM_007294.3(BRCA1):c.4372C>T (p.Gln1458Ter)
NM_007294.3(BRCA1):c.5153G>A (p.Trp1718Ter)
NM_007294.3(BRCA1):c.5445G>A (p.Trp1815Ter)
NM_007294.3(BRCA1):c.5510G>A (p.Trp1837Ter)
NM_007294.3(BRCA1):c.5346G>A (p.Trp1782Ter)
NM_007294.3(BRCA1):c.1116G>A (p.Trp372Ter)
NM_007294.3(BRCA1):c.1999C>T (p.Gln667Ter)
NM_007294.3(BRCA1):c.4183C>T (p.Gln1395Ter)
NM_007294.3(BRCA1):c.4810C>T (p.Gln1604Ter)
NM_007294.3(BRCA1):c.850C>T (p.Gln284Ter)
NM_007294.3(BRCA1):c.1058G>A (p.Trp353Ter)
NM_007294.3(BRCA1):c.131G>A (p.Cys44Tyr)
NM_007294.3(BRCA1):c.1600C>T (p.Gln534Ter)
NM_007294.3(BRCA1):c.3286C>T (p.Gln1096Ter)
NM_007294.3(BRCA1):c.3403C>T (p.Gln1135Ter)
NM_007294.3(BRCA1):c.34C>T (p.Gln12Ter)
NM_007294.3(BRCA1):c.4258C>T (p.Gln1420Ter)
NM_007294.3(BRCA1):c.4609C>T (p.Gln1537Ter)
NM_007294.3(BRCA1):c.5154G>A (p.Trp1718Ter)
NM_007294.3(BRCA1):c.5431C>T (p.Gln1811Ter)
NM_007294.3(BRCA1):c.241C>T (p.Gln81Ter)
NM_007294.3(BRCA1):c.3331C>T (p.Gln1111Ter)
NM_007294.3(BRCA1):c.3967C>T (p.Gln1323Ter)
NM_007294.3(BRCA1):c.415C>T (p.Gln139Ter)
NM_007294.3(BRCA1):c.505C>T (p.Gln169Ter)
NM_007294.3(BRCA1): c.5194-12G>A
NM_007294.3(BRCA1):c.5212G>A (p.Gly1738Arg)
NM_007294.3(BRCA1):c.5332+1G>A
NM_007294.3(BRCA1):c.1480C>T (p.Gln494Ter)
NM_007294.3(BRCA1):c.2563C>T (p.Gln855Ter)
NM_007294.3(BRCA1):c.1066C>T (p.Gln356Ter)
NM_007294.3(BRCA1):c.3718C>T (p.Gln1240Ter)
NM_007294.3(BRCA1):c.3817C>T (p.Gln1273Ter)
NM_007294.3(BRCA1):c.3937C>T (p.Gln1313Ter)
NM_007294.3(BRCA1): c.4357+1G>A
NM_007294.3(BRCA1): c.5074+1G>A
NM_007294.3(BRCA1):c.5277+1G>A
NM_007294.3(BRCA1):c.2338C>T (p.Gln780Ter)
NM_007294.3(BRCA1):c.3598C>T (p.Gln1200Ter)
NM_007294.3(BRCA1):c.3841C>T (p.Gln1281Ter)
NM_007294.3(BRCA1):c.4222C>T (p.Gln1408Ter)
NM_007294.3(BRCA1):c.4524G>A (p.Trp1508Ter)
NM_007294.3(BRCA1):c.5353C>T (p.Gln1785Ter)
NM_007294.3(BRCA1):c.962G>A (p.Trp321Ter)
NM_007294.3(BRCA1):c.220C>T (p.Gln74Ter)
NM_007294.3(BRCA1):c.2713C>T (p.Gln905Ter)
NM_007294.3(BRCA1):c.2800C>T (p.Gln934Ter)
NM_007294.3(BRCA1):c.4612C>T (p.Gln1538Ter)
NM_007294.3(BRCA1):c.3352C>T (p.Gln1118Ter)
NM_007294.3(BRCA1):c.4834C>T (p.Gln1612Ter)
NM_007294.3(BRCA1):c.4523G>A (p.Trp1508Ter)
NM_007294.3(BRCA1):c.5135G>A (p.Trp1712Ter)
NM_007294.3(BRCA1):c.1155G>A (p.Trp385Ter)
NM_007294.3(BRCA1):c.4987-1G>A
NM_000059.3(BRCA2):c.9573G>A (p.Trp3191Ter)
NM_000059.3(BRCA2):c.1945C>T (p.Gln649Ter)
NM_000059.3(BRCA2):c.217C>T (p.Gln73Ter)
NM_000059.3(BRCA2):c.523C>T (p.Gln175Ter)
NM_000059.3(BRCA2):c.2548C>T (p.Gln850Ter)
NM_000059.3(BRCA2):c.2905C>T (p.Gln969Ter)
NM_000059.3(BRCA2):c.4689G>A (p.Trp1563Ter)
NM_000059.3(BRCA2):c.4972C>T (p.Gln1658Ter)
NM_000059.3(BRCA2):c.1184G>A (p.Trp395Ter)
NM_000059.3(BRCA2):c.2137C>T (p.Gln713Ter)
NM_000059.3(BRCA2):c.3217C>T (p.Gln1073Ter)
NM_000059.3(BRCA2):c.3523C>T (p.Gln1175Ter)
NM_000059.3(BRCA2):c.4783C>T (p.Gln1595Ter)
NM_000059.3(BRCA2):c.5800C>T (p.Gln1934Ter)
NM_000059.3(BRCA2):c.6478C>T (p.Gln2160Ter)
NM_000059.3(BRCA2):c.7033C>T (p.Gln2345Ter)

NM_000059.3(BRCA2):c.7495C>T (p.Gln2499Ter)
NM_000059.3(BRCA2):c.7501C>T (p.Gln2501Ter)
NM_000059.3(BRCA2):c.7887G>A (p.Trp2629Ter)
NM_000059.3(BRCA2):c.8910G>A (p.Trp2970Ter)
NM_000059.3(BRCA2):c.9139C>T (p.Gln3047Ter)
NM_000059.3(BRCA2):c.9739C>T (p.Gln3247Ter)
NM_000059.3(BRCA2):c.582G>A (p.Trp194Ter)
NM_000059.3(BRCA2):c.7963C>T (p.Gln2655Ter)
NM_000059.3(BRCA2):c.8695C>T (p.Gln2899Ter)
NM_000059.3(BRCA2):c.8869C>T (p.Gln2957Ter)
NM_000059.3(BRCA2):c.1117C>T (p.Gln373Ter)
NM_000059.3(BRCA2):c.1825C>T (p.Gln609Ter)
NM_000059.3(BRCA2):c.2455C>T (p.Gln819Ter)
NM_000059.3(BRCA2):c.2881C>T (p.Gln961Ter)
NM_000059.3(BRCA2):c.3265C>T (p.Gln1089Ter)
NM_000059.3(BRCA2):c.3283C>T (p.Gln1095Ter)
NM_000059.3(BRCA2):c.3442C>T (p.Gln1148Ter)
NM_000059.3(BRCA2):c.3871C>T (p.Gln1291Ter)
NM_000059.3(BRCA2):c.439C>T (p.Gln147Ter)
NM_000059.3(BRCA2):c.4525C>T (p.Gln1509Ter)
NM_000059.3(BRCA2):c.475+1G>A
NM_000059.3(BRCA2):c.5344C>T (p.Gln1782Ter)
NM_000059.3(BRCA2):c.5404C>T (p.Gln1802Ter)
NM_000059.3(BRCA2):c.5773C>T (p.Gln1925Ter)
NM_000059.3(BRCA2):c.5992C>T (p.Gln1998Ter)
NM_000059.3(BRCA2):c.6469C>T (p.Gln2157Ter)
NM_000059.3(BRCA2):c.7261C>T (p.Gln2421Ter)
NM_000059.3(BRCA2):c.7303C>T (p.Gln2435Ter)
NM_000059.3(BRCA2):c.7471C>T (p.Gln2491Ter)
NM_000059.3(BRCA2):c.7681C>T (p.Gln2561Ter)
NM_000059.3(BRCA2):c.7738C>T (p.Gln2580Ter)
NM_000059.3(BRCA2):c.7886G>A (p.Trp2629Ter)
NM_000059.3(BRCA2):c.8140C>T (p.Gln2714Ter)
NM_000059.3(BRCA2):c.8363G>A (p.Trp2788Ter)
NM_000059.3(BRCA2):c.8572C>T (p.Gln2858Ter)
NM_000059.3(BRCA2):c.8773C>T (p.Gln2925Ter)
NM_000059.3(BRCA2):c.8821C>T (p.Gln2941Ter)
NM_000059.3(BRCA2):c.9109C>T (p.Gln3037Ter)
NM_000059.3(BRCA2):c.9317G>A (p.Trp3106Ter)
NM_000059.3(BRCA2):c.9466C>T (p.Gln3156Ter)
NM_000059.3(BRCA2):c.9572G>A (p.Trp3191Ter)
NM_000059.3(BRCA2):c.8490G>A (p.Trp2830Ter)
NM_000059.3(BRCA2):c.5980C>T (p.Gln1994Ter)
NM_000059.3(BRCA2):c.7721G>A (p.Trp2574Ter)
NM_000059.3(BRCA2):c.196C>T (p.Gln66Ter)
NM_000059.3(BRCA2):c.7618-1G>A
NM_000059.3(BRCA2):c.8489G>A (p.Trp2830Ter)
NM_000059.3(BRCA2):c.7857G>A (p.Trp2619Ter)
NM_000059.3(BRCA2):c.1261C>T (p.Gln421Ter)
NM_000059.3(BRCA2):c.1456C>T (p.Gln486Ter)
NM_000059.3(BRCA2):c.3319C>T (p.Gln1107Ter)
NM_000059.3(BRCA2):c.5791C>T (p.Gln1931Ter)
NM_000059.3(BRCA2):c.6070C>T (p.Gln2024Ter)
NM_000059.3(BRCA2):c.7024C>T (p.Gln2342Ter)
NM_000059.3(BRCA2):c.961C>T (p.Gln321Ter)
NM_000059.3(BRCA2):c.9380G>A (p.Trp3127Ter)
NM_000059.3(BRCA2):c.8364G>A (p.Trp2788Ter)
NM_000059.3(BRCA2):c.7758G>A (p.Trp2586Ter)
NM_000059.3(BRCA2):c.2224C>T (p.Gln742Ter)
NM_000059.3(BRCA2):c.5101C>T (p.Gln1701Ter)
NM_000059.3(BRCA2):c.5959C>T (p.Gln1987Ter)
NM_000059.3(BRCA2):c.7060C>T (p.Gln2354Ter)
NM_000059.3(BRCA2):c.9100C>T (p.Gln3034Ter)
NM_000059.3(BRCA2):c.9148C>T (p.Gln3050Ter)
NM_000059.3(BRCA2):c.9883C>T (p.Gln3295Ter)
NM_000059.3(BRCA2):c.1414C>T (p.Gln472Ter)
NM_000059.3(BRCA2):c.1689G>A (p.Trp563Ter)
NM_000059.3(BRCA2):c.581G>A (p.Trp194Ter)
NM_000059.3(BRCA2):c.6490C>T (p.Gln2164Ter)
NM_000059.3(BRCA2):c.7856G>A (p.Trp2619Ter)
NM_000059.3(BRCA2):c.8970G>A (p.Trp2990Ter)
NM_000059.3(BRCA2):c.92G>A (p.Trp31Ter)
NM_000059.3(BRCA2):c.9376C>T (p.Gln3126Ter)
NM_000059.3(BRCA2):c.93G>A (p.Trp31Ter)
NM_000059.3(BRCA2):c.1189C>T (p.Gln397Ter)
NM_000059.3(BRCA2):c.2818C>T (p.Gln940Ter)
NM_000059.3(BRCA2):c.2979G>A (p.Trp993Ter)
NM_000059.3(BRCA2):c.3166C>T (p.Gln1056Ter)
NM_000059.3(BRCA2):c.4285C>T (p.Gln1429Ter)
NM_000059.3(BRCA2):c.6025C>T (p.Gln2009Ter)
NM_000059.3(BRCA2):c.772C>T (p.Gln258Ter)
NM_000059.3(BRCA2):c.7877G>A (p.Trp2626Ter)
NM_000059.3(BRCA2):c.3109C>T (p.Gln1037Ter)
NM_000059.3(BRCA2):c.4222C>T (p.Gln1408Ter)
NM_000059.3(BRCA2):c.7480C>T (p.Arg2494Ter)
NM_000059.3(BRCA2):c.7878G>A (p.Trp2626Ter)
NM_000059.3(BRCA2):c.9076C>T (p.Gln3026Ter)
NM_000059.3(BRCA2):c.1855C>T (p.Gln619Ter)
NM_000059.3(BRCA2):c.4111C>T (p.Gln1371Ter)
NM_000059.3(BRCA2):c.5656C>T (p.Gln1886Ter)
NM_000059.3(BRCA2):c.7757G>A (p.Trp2586Ter)
NM_000059.3(BRCA2):c.8243G>A (p.Gly2748Asp)
NM_000059.3(BRCA2):c.8878C>T (p.Gln2960Ter)
NM_000059.3(BRCA2):c.8487+1G>A
NM_000059.3(BRCA2):c.8677C>T (p.Gln2893Ter)
NM_000059.3(BRCA2):c.250C>T (p.Gln84Ter)
NM_000059.3(BRCA2):c.6124C>T (p.Gln2042Ter)
NM_000059.3(BRCA2):c.7617+1G>A
NM_000059.3(BRCA2):c.8575C>T (p.Gln2859Ter)
NM_000059.3(BRCA2):c.8174G>A (p.Trp2725Ter)
NM_000059.3(BRCA2):c.3187C>T (p.Gln1063Ter)
NM_000059.3(BRCA2):c.9381G>A (p.Trp3127Ter)
NM_000059.3(BRCA2):c.2095C>T (p.Gln699Ter)
NM_000059.3(BRCA2):c.1642C>T (p.Gln548Ter)
NM_000059.3(BRCA2):c.8608C>T (p.Gln2870Ter)
NM_000059.3(BRCA2):c.3412C>T (p.Gln1138Ter)
NM_000059.3(BRCA2):c.4246C>T (p.Gln1416Ter)
NM_000059.3(BRCA2):c.6475C>T (p.Gln2159Ter)
NM_000059.3(BRCA2):c.7366C>T (p.Gln2456Ter)
NM_000059.3(BRCA2):c.7516C>T (p.Gln2506Ter)
NM_000059.3(BRCA2):c.8969G>A (p.Trp2990Ter)
NM_000059.3(BRCA2):c.6487C>T (p.Gln2163Ter)
NM_000059.3(BRCA2):c.2978G>A (p.Trp993Ter)
NM_000059.3(BRCA2):c.7615C>T (p.Gln2539Ter)
NM_000059.3(BRCA2):c.9106C>T (p.Gln3036Ter)

See Table A. Accordingly, an aspect of the invention relates to a method for treating or preventing Breast-Ovarian Cancer by correcting one or more pathogenic G-to-A or C-to-T mutations/SNPs, particularly one or more pathogenic G-to-A or C-to-T mutations/SNPs present in the BRCA1 or BRCA2 gene, and more particularly one or more pathogenic G-to-A or C-to-T mutations/SNPs described above.

Lynch Syndrome

In some embodiments, the methods, systems, and compositions described herein are used to correct one or more pathogenic G-to-A or C-to-T mutations/SNPs associated with Lynch syndrome. In some embodiment, the pathogenic mutations/SNPs are present in at least one gene selected from MSH6, MSH2, EPCAM, PMS2, and MLH1, including at least the followings:

NM_000179.2(MSH6):c.1045C>T (p.Gln349Ter)
NM_000251.2(MSH2):c.1384C>T (p.Gln462Ter)
NM_002354.2(EPCAM):c.133C>T (p.Gln45Ter)
NM_002354.2(EPCAM):c.429G>A (p.Trp143Ter)

NM_002354.2(EPCAM):c.523C>T (p.Gln175Ter)
NM_000179.2(MSH6):c.2680C>T (p.Gln894Ter)
NM_000251.2(MSH2):c.350G>A (p.Trp117Ter)
NM_000179.2(MSH6):c.2735G>A (p.Trp912Ter)
NM_000179.2(MSH6):c.3556+1G>A
NM_000251.2(MSH2):c.388C>T (p.Gln130Ter)
NM_000535.6(PMS2):c.1912C>T (p.Gln638Ter)
NM_000535.6(PMS2):c.1891C>T (p.Gln631Ter)
NM_000249.3(MLH1):c.454-1G>A
NM_000251.2(MSH2):c.1030C>T (p.Gln344Ter)
NM_000179.2(MSH6):c.2330G>A (p.Trp777Ter)
NM_000179.2(MSH6):c.2191C>T (p.Gln731Ter)
NM_000179.2(MSH6):c.2764C>T (p.Arg922Ter)
NM_000179.2(MSH6):c.2815C>T (p.Gln939Ter)
NM_000179.2(MSH6):c.3020G>A (p.Trp1007Ter)
NM_000179.2(MSH6):c.3436C>T (p.Gln1146Ter)
NM_000179.2(MSH6):c.3647-1G>A
NM_000179.2(MSH6):c.3772C>T (p.Gln1258Ter)
NM_000179.2(MSH6):c.3838C>T (p.Gln1280Ter)
NM_000179.2(MSH6):c.706C>T (p.Gln236Ter)
NM_000179.2(MSH6):c.730C>T (p.Gln244Ter)
NM_000249.3(MLH1):c.1171C>T (p.Gln391Ter)
NM_000249.3(MLH1):c.1192C>T (p.Gln398Ter)
NM_000249.3(MLH1):c.1225C>T (p.Gln409Ter)
NM_000249.3(MLH1):c.1276C>T (p.Gln426Ter)
NM_000249.3(MLH1):c.1528C>T (p.Gln510Ter)
NM_000249.3(MLH1):c.1609C>T (p.Gln537Ter)
NM_000249.3(MLH1):c.1613G>A (p.Trp538Ter)
NM_000249.3(MLH1):c.1614G>A (p.Trp538Ter)
NM_000249.3(MLH1):c.1624C>T (p.Gln542Ter)
NM_000249.3(MLH1):c.1684C>T (p.Gln562Ter)
NM_000249.3(MLH1):c.1731+1G>A
NM_000249.3(MLH1):c.1731+5G>A
NM_000249.3(MLH1):c.1732-1G>A
NM_000249.3(MLH1):c.1896G>A (p.Glu632=)
NM_000249.3(MLH1):c.1989+1G>A
NM_000249.3(MLH1):c.1990-1G>A
NM_000249.3(MLH1):c.1998G>A (p.Trp666Ter)
NM_000249.3(MLH1): c.208-1G>A
NM_000249.3(MLH1):c.2101C>T (p.Gln701Ter)
NM_000249.3(MLH1):c.2136G>A (p.Trp712Ter)
NM_000249.3(MLH1):c.2224C>T (p.Gln742Ter)
NM_000249.3(MLH1):c.230G>A (p.Cys77Tyr)
NM_000249.3(MLH1):c.256C>T (p.Gln86Ter)
NM_000249.3(MLH1):c.436C>T (p.Gln146Ter)
NM_000249.3(MLH1):c.445C>T (p.Gln149Ter)
NM_000249.3(MLH1):c.545G>A (p.Arg182Lys)
NM_000249.3(MLH1):c.731G>A (p.Gly244Asp)
NM_000249.3(MLH1):c.76C>T (p.Gln26Ter)
NM_000249.3(MLH1):c.842C>T (p.Ala281Val)
NM_000249.3(MLH1):c.882C>T (p.Leu294=)
NM_000249.3(MLH1):c.901C>T (p.Gln301Ter)
NM_000251.2(MSH2):c.1013G>A (p.Gly338Glu)
NM_000251.2(MSH2):c.1034G>A (p.Trp345Ter)
NM_000251.2(MSH2):c.1129C>T (p.Gln377Ter)
NM_000251.2(MSH2):c.1183C>T (p.Gln395Ter)
NM_000251.2(MSH2):c.1189C>T (p.Gln397Ter)
NM_000251.2(MSH2):c.1204C>T (p.Gln402Ter)
NM_000251.2(MSH2):c.1276+1G>A
NM_000251.2(MSH2):c.1528C>T (p.Gln510Ter)
NM_000251.2(MSH2):c.1552C>T (p.Gln518Ter)
NM_000251.2(MSH2):c.1720C>T (p.Gln574Ter)
NM_000251.2(MSH2):c.1777C>T (p.Gln593Ter)
NM_000251.2(MSH2):c.1885C>T (p.Gln629Ter)
NM_000251.2(MSH2):c.2087C>T (p.Pro696Leu)
NM_000251.2(MSH2):c.2251G>A (p.Gly751Arg)
NM_000251.2(MSH2):c.2291G>A (p.Trp764Ter)
NM_000251.2(MSH2):c.2292G>A (p.Trp764Ter)
NM_000251.2(MSH2):c.2446C>T (p.Gln816Ter)
NM_000251.2(MSH2):c.2470C>T (p.Gln824Ter)
NM_000251.2(MSH2):c.2536C>T (p.Gln846Ter)
NM_000251.2(MSH2):c.2581C>T (p.Gln861Ter)
NM_000251.2(MSH2):c.2634G>A (p.Glu878=)
NM_000251.2(MSH2):c.2635C>T (p.Gln879Ter)
NM_000251.2(MSH2):c.28C>T (p.Gln10Ter)
NM_000251.2(MSH2):c.472C>T (p.Gln158Ter)
NM_000251.2(MSH2):c.478C>T (p.Gln160Ter)
NM_000251.2(MSH2):c.484G>A (p.Gly162Arg)
NM_000251.2(MSH2):c.490G>A (p.Gly164Arg)
NM_000251.2(MSH2):c.547C>T (p.Gln183Ter)
NM_000251.2(MSH2):c.577C>T (p.Gln193Ter)
NM_000251.2(MSH2):c.643C>T (p.Gln215Ter)
NM_000251.2(MSH2):c.645+1G>A
NM_000251.2(MSH2):c.652C>T (p.Gln218Ter)
NM_000251.2(MSH2):c.754C>T (p.Gln252Ter)
NM_000251.2(MSH2):c.792+1G>A
NM_000251.2(MSH2):c.942G>A (p.Gln314=)
NM_000535.6(PMS2):c.949C>T (p.Gln317Ter)
NM_000249.3(MLH1):c.306+1G>A
NM_000249.3(MLH1):c.62C>T (p.Ala21Val)
NM_000251.2(MSH2):c.1865C>T (p.Pro622Leu)
NM_000179.2(MSH6):c.426G>A (p.Trp142Ter)
NM_000251.2(MSH2):c.715C>T (p.Gln239Ter)
NM_000249.3(MLH1):c.350C>T (p.Thr117Met)
NM_000251.2(MSH2):c.1915C>T (p.His639Tyr)
NM_000251.2(MSH2):c.289C>T (p.Gln97Ter)
NM_000251.2(MSH2):c.2785C>T (p.Arg929Ter)
NM_000249.3(MLH1):c.131C>T (p.Ser44Phe)
NM_000249.3(MLH1):c.1219C>T (p.Gln407Ter)
NM_000249.3(MLH1):c.306+5G>A
NM_000251.2(MSH2):c.1801C>T (p.Gln601Ter)
NM_000535.6(PMS2):c.1144+1G>A
NM_000251.2(MSH2):c.1984C>T (p.Gln662Ter)
NM_000249.3(MLH1): c.381-1G>A
NM_000535.6(PMS2):c.631C>T (p.Arg211Ter)
NM_000251.2(MSH2):c.790C>T (p.Gln264Ter)
NM_000251.2(MSH2): c.366+1G>A
NM_000249.3(MLH1):c.298C>T (p.Arg100Ter)
NM_000179.2(MSH6):c.3013C>T (p.Arg1005Ter)
NM_000179.2(MSH6):c.694C>T (p.Gln232Ter)
NM_000179.2(MSH6):c.742C>T (p.Arg248Ter)
NM_000249.3(MLH1):c.1039-1G>A
NM_000249.3(MLH1):c.142C>T (p.Gln48Ter)
NM_000249.3(MLH1):c.1790G>A (p.Trp597Ter)
NM_000249.3(MLH1):c.1961C>T (p.Pro654Leu)
NM_000249.3(MLH1):c.2103+1G>A
NM_000249.3(MLH1):c.2135G>A (p.Trp712Ter)
NM_000249.3(MLH1): c.588+5G>A
NM_000249.3(MLH1):c.790+1G>A
NM_000251.2(MSH2):c.1035G>A (p.Trp345Ter)
NM_000251.2(MSH2):c.1255C>T (p.Gln419Ter)
NM_000251.2(MSH2):c.1861C>T (p.Arg621Ter)
NM_000251.2(MSH2):c.226C>T (p.Gln76Ter)
NM_000251.2(MSH2):c.2653C>T (p.Gln885Ter)
NM_000251.2(MSH2):c.508C>T (p.Gln170Ter)
NM_000251.2(MSH2):c.862C>T (p.Gln288Ter)
NM_000251.2(MSH2):c.892C>T (p.Gln298Ter)
NM_000251.2(MSH2):c.970C>T (p.Gln324Ter)
NM_000179.2(MSH6):c.4001G>A (p.Arg1334Gln)
NM_000251.2(MSH2):c.1662-1G>A
NM_000535.6(PMS2):c.1882C>T (p.Arg628Ter)
NM_000535.6(PMS2):c.2174+1G>A
NM_000535.6(PMS2):c.2404C>T (p.Arg802Ter)
NM_000179.2(MSH6):c.3991C>T (p.Arg1331Ter)

NM_000179.2(MSH6):c.2503C>T (p.Gln835Ter)
NM_000179.2(MSH6):c.718C>T (p.Arg240Ter)
NM_000249.3(MLH1):c.1038G>A (p.Gln346=)
NM_000249.3(MLH1):c.245C>T (p.Thr82Ile)
NM_000249.3(MLH1):c.83C>T (p.Pro28Leu)
NM_000249.3(MLH1):c.884G>A (p.Ser295Asn)
NM_000249.3(MLH1):c.982C>T (p.Gln328Ter)
NM_000251.2(MSH2):c.1046C>T (p.Pro349Leu)
NM_000251.2(MSH2):c.1120C>T (p.Gln374Ter)
NM_000251.2(MSH2):c.1285C>T (p.Gln429Ter)
NM_000251.2(MSH2):c.1477C>T (p.Gln493Ter)
NM_000251.2(MSH2):c.2152C>T (p.Gln718Ter)
NM_000535.6(PMS2):c.703C>T (p.Gln235Ter)
NM_000249.3(MLH1):c.2141G>A (p.Trp714Ter)
NM_000251.2(MSH2):c.1009C>T (p.Gln337Ter)
NM_000251.2(MSH2):c.1216C>T (p.Arg406Ter)
NM_000179.2(MSH6):c.3202C>T (p.Arg1068Ter)
NM_000251.2(MSH2):c.1165C>T (p.Arg389Ter)
NM_000249.3(MLH1):c.1943C>T (p.Pro648Leu)
NM_000249.3(MLH1):c.200G>A (p.Gly67Glu)
NM_000249.3(MLH1):c.793C>T (p.Arg265Cys)
NM_000249.3(MLH1):c.2059C>T (p.Arg687Trp)
NM_000249.3(MLH1):c.677G>A (p.Arg226Gln)
NM_000249.3(MLH1):c.2041G>A (p.Ala681Thr)
NM_000249.3(MLH1):c.1942C>T (p.Pro648Ser)
NM_000249.3(MLH1):c.676C>T (p.Arg226Ter)
NM_000251.2(MSH2):c.2038C>T (p.Arg680Ter)
NM_000179.2(MSH6):c.1483C>T (p.Arg495Ter)
NM_000179.2(MSH6):c.2194C>T (p.Arg732Ter)
NM_000179.2(MSH6):c.3103C>T (p.Arg1035Ter)
NM_000179.2(MSH6):c.892C>T (p.Arg298Ter)
NM_000249.3(MLH1):c.1459C>T (p.Arg487Ter)
NM_000249.3(MLH1):c.1731G>A (p.Ser577=)
NM_000249.3(MLH1):c.184C>T (p.Gln62Ter)
NM_000249.3(MLH1):c.1975C>T (p.Arg659Ter)
NM_000249.3(MLH1):c.199G>A (p.Gly67Arg)
NM_000251.2(MSH2):c.1076+1G>A
NM_000251.2(MSH2):c.1147C>T (p.Arg383Ter)
NM_000251.2(MSH2):c.181C>T (p.Gln61Ter)
NM_000251.2(MSH2):c.212-1G>A
NM_000251.2(MSH2):c.2131C>T (p.Arg711Ter)
NM_000535.6(PMS2):c.697C>T (p.Gln233Ter)
NM_000535.6(PMS2):c.1261C>T (p.Arg421Ter)
NM_000251.2(MSH2):c.2047G>A (p.Gly683Arg)
NM_000535.6(PMS2):c.400C>T (p.Arg134Ter)
NM_000535.6(PMS2):c.1927C>T (p.Gln643Ter)
NM_000179.2(MSH6):c.1444C>T (p.Arg482Ter)
NM_000179.2(MSH6):c.2731C>T (p.Arg911Ter)
NM_000535.6(PMS2):c.943C>T (p.Arg315Ter)

See Table A. Accordingly, an aspect of the invention relates to a method for treating or preventing Lynch syndrome by correcting one or more pathogenic G-to-A or C-to-T mutations/SNPs, particularly one or more pathogenic G-to-A or C-to-T mutations/SNPs present in at least one gene selected from BCKDHA, BCKDHB, DBT, and DLD, and more particularly one or more pathogenic G-to-A or C-to-T mutations/SNPs described above.

Other Genetic Diseases

Pathogenic G-to-A or C-to-T mutations/SNPs associated with additional genetic diseases are also reported in the ClinVar database and disclosed in Table A, including but not limited to Marfan syndrome, Hurler syndrome, Glycogen Storage Disease, and Cystic Fibrosis. Accordingly, an aspect of the invention relates to a method for correcting one or more pathogenic G-to-A or C-to-T mutations/SNPs associated with any of these diseases, as discussed below.

Marfan Syndrome

In some embodiments, the methods, systems, and compositions described herein are used to correct one or more pathogenic G-to-A or C-to-T mutations/SNPs associated with Marfan syndrome. In some embodiment, the pathogenic mutations/SNPs are present in at least the FBN1 gene, including at least the followings:

NM_000138.4(FBN1):c.1879C>T (p.Arg627Cys)
NM_000138.4(FBN1):c.1051C>T (p.Gln351Ter)
NM_000138.4(FBN1):c.184C>T (p.Arg62Cys)
NM_000138.4(FBN1):c.2855-1G>A
NM_000138.4(FBN1):c.3164G>A (p.Cys1055Tyr)
NM_000138.4(FBN1):c.368G>A (p.Cys123Tyr)
NM_000138.4(FBN1):c.4955G>A (p.Cys1652Tyr)
NM_000138.4(FBN1):c.7180C>T (p.Arg2394Ter)
NM_000138.4(FBN1):c.8267G>A (p.Trp2756Ter)
NM_000138.4(FBN1):c.1496G>A (p.Cys499Tyr)
NM_000138.4(FBN1):c.6886C>T (p.Gln2296Ter)
NM_000138.4(FBN1):c.3373C>T (p.Arg1125Ter)
NM_000138.4(FBN1):c.640G>A (p.Gly214Ser)
NM_000138.4(FBN1):c.5038C>T (p.Gln1680Ter)
NM_000138.4(FBN1):c.434G>A (p.Cys145Tyr)
NM_000138.4(FBN1):c.2563C>T (p.Gln855Ter)
NM_000138.4(FBN1):c.7466G>A (p.Cys2489Tyr)
NM_000138.4(FBN1):c.2089C>T (p.Gln697Ter)
NM_000138.4(FBN1):c.592C>T (p.Gln198Ter)
NM_000138.4(FBN1):c.6695G>A (p.Cys2232Tyr)
NM_000138.4(FBN1):c.6164-1G>A
NM_000138.4(FBN1):c.5627G>A (p.Cys1876Tyr)
NM_000138.4(FBN1):c.4061G>A (p.Trp1354Ter)
NM_000138.4(FBN1):c.1982G>A (p.Cys661Tyr)
NM_000138.4(FBN1):c.6784C>T (p.Gln2262Ter)
NM_000138.4(FBN1):c.409C>T (p.Gln137Ter)
NM_000138.4(FBN1):c.364C>T (p.Arg122Cys)
NM_000138.4(FBN1):c.3217G>A (p.Glu1073Lys)
NM_000138.4(FBN1):c.4460-8G>A
NM_000138.4(FBN1):c.4786C>T (p.Arg1596Ter)
NM_000138.4(FBN1):c.7806G>A (p.Trp2602Ter)
NM_000138.4(FBN1):c.247+1G>A
NM_000138.4(FBN1):c.2495G>A (p.Cys832Tyr)
NM_000138.4(FBN1):c.493C>T (p.Arg165Ter)
NM_000138.4(FBN1):c.5504G>A (p.Cys1835Tyr)
NM_000138.4(FBN1):c.5863C>T (p.Gln1955Ter)
NM_000138.4(FBN1):c.6658C>T (p.Arg2220Ter)
NM_000138.4(FBN1):c.7606G>A (p.Gly2536Arg)
NM_000138.4(FBN1):c.7955G>A (p.Cys2652Tyr)
NM_000138.4(FBN1):c.3037G>A (p.Gly1013Arg)
NM_000138.4(FBN1):c.8080C>T (p.Arg2694Ter)
NM_000138.4(FBN1):c.1633C>T (p.Arg545Cys)
NM_000138.4(FBN1):c.7205-1G>A
NM_000138.4(FBN1):c.4621C>T (p.Arg1541Ter)
NM_000138.4(FBN1):c.1090C>T (p.Arg364Ter)
NM_000138.4(FBN1):c.1585C>T (p.Arg529Ter)
NM_000138.4(FBN1):c.4781G>A (p.Gly1594Asp)
NM_000138.4(FBN1):c.643C>T (p.Arg215Ter)
NM_000138.4(FBN1):c.3668G>A (p.Cys1223Tyr)
NM_000138.4(FBN1):c.8326C>T (p.Arg2776Ter)
NM_000138.4(FBN1):c.6354C>T (p.Ile2118=)
NM_000138.4(FBN1):c.1468+5G>A
NM_000138.4(FBN1):c.1546C>T (p.Arg516Ter)
NM_000138.4(FBN1):c.4615C>T (p.Arg1539Ter)
NM_000138.4(FBN1):c.5368C>T (p.Arg1790Ter)
NM_000138.4(FBN1):c.1285C>T (p.Arg429Ter)

See Table A. Accordingly, an aspect of the invention relates to a method for treating or preventing Marfan syndrome by correcting one or more pathogenic G-to-A or C-to-T mutations/SNPs, particularly one or more pathogenic G-to-A or C-to-T mutations/SNPs present in the FBN1 gene, and more particularly one or more pathogenic G-to-A or C-to-T mutations/SNPs described above.

Hurler Syndrome

In some embodiments, the methods, systems, and compositions described herein are used to correct one or more pathogenic G-to-A or C-to-T mutations/SNPs associated with Hurler syndrome. In some embodiment, the pathogenic mutations/SNPs are present in at least the IDUA gene, including at least the followings:

NM_000203.4(IDUA):c.972+1G>A
NM_000203.4(IDUA):c.1855C>T (p.Arg619Ter)
NM_000203.4(IDUA):c.152G>A (p.Gly51Asp)
NM_000203.4(IDUA):c.1205G>A (p.Trp402Ter)
NM_000203.4(IDUA):c.208C>T (p.Gln70Ter)
NM_000203.4(IDUA):c.1045G>A (p.Asp349Asn)
NM_000203.4(IDUA):c.1650+5G>A

See Table A. Accordingly, an aspect of the invention relates to a method for treating or preventing Hurler syndrome by correcting one or more pathogenic G-to-A or C-to-T mutations/SNPs, particularly one or more pathogenic G-to-A or C-to-T mutations/SNPs present in the IDUA gene, and more particularly one or more pathogenic G-to-A or C-to-T mutations/SNPs described above.

Glycogen Storage Disease

In some embodiments, the methods, systems, and compositions described herein are used to correct one or more pathogenic G-to-A or C-to-T mutations/SNPs associated with Glycogen Storage Disease. In some embodiment, the pathogenic mutations/SNPs are present in at least one gene selected from GAA, AGL, PHKB, PRKAG2, G6PC, PGAM2, GBE1, PYGM, and PFKM, including at least the followings:

NM_000152.4(GAA):c.1927G>A (p.Gly643Arg)
NM_000152.4(GAA):c.2173C>T (p.Arg725Trp)
NM_000642.2(AGL):c.3980G>A (p.Trp1327Ter)
NM_000642.2(AGL):c.16C>T (p.Gln6Ter)
NM_000642.2(AGL):c.2039G>A (p.Trp680Ter)
NM_000293.2(PHKB):c.1546C>T (p.Gln516Ter)
NM_016203.3(PRKAG2):c.1592G>A (p.Arg531Gln)
NM_000151.3(G6PC):c.248G>A (p.Arg83His)
NM_000151.3(G6PC):c.724C>T (p.Gln242Ter)
NM_000151.3(G6PC):c.883C>T (p.Arg295Cys)
NM_000151.3(G6PC):c.247C>T (p.Arg83Cys)
NM_000151.3(G6PC):c.1039C>T (p.Gln347Ter)
NM_000152.4(GAA):c.1561G>A (p.Glu521Lys)
NM_000642.2(AGL):c.2590C>T (p.Arg864Ter)
NM_000642.2(AGL):c.3682C>T (p.Arg1228Ter)
NM_000642.2(AGL):c.118C>T (p.Gln40Ter)
NM_000642.2(AGL):c.256C>T (p.Gln86Ter)
NM_000642.2(AGL):c.2681+1G>A
NM_000642.2(AGL):c.2158-1G>A
NM_000290.3(PGAM2):c.233G>A (p.Trp78Ter)
NM_000152.4(GAA):c.1548G>A (p.Trp516Ter)
NM_000152.4(GAA):c.2014C>T (p.Arg672Trp)
NM_000152.4(GAA):c.546G>A (p.Thr182=)
NM_000152.4(GAA):c.1802C>T (p.Ser601Leu)
NM_000152.4(GAA): c.1754+1G>A
NM_000152.4(GAA):c.1082C>T (p.Pro361Leu)
NM_000152.4(GAA):c.2560C>T (p.Arg854Ter)
NM_000152.4(GAA):c.655G>A (p.Gly219Arg)
NM_000152.4(GAA):c.1933G>A (p.Asp645Asn)
NM_000152.4(GAA):c.1979G>A (p.Arg660His)
NM_000152.4(GAA):c.1465G>A (p.Asp489Asn)
NM_000152.4(GAA):c.2512C>T (p.Gln838Ter)
NM_000158.3(GBE1):c.1543C>T (p.Arg515Cys)
NM_005609.3(PYGM):c.1726C>T (p.Arg576Ter)
NM_005609.3(PYGM):c.1827G>A (p.Lys609=)
NM_005609.3(PYGM):c.148C>T (p.Arg50Ter)
NM_005609.3(PYGM):c.613G>A (p.Gly205Ser)
NM_005609.3(PYGM):c.1366G>A (p.Val456Met)
NM_005609.3(PYGM):c.1768+1G>A
NM_001166686.1(PFKM):c.450+1G>A

See Table A. Accordingly, an aspect of the invention relates to a method for treating or preventing Glycogen Storage Disease by correcting one or more pathogenic G-to-A or C-to-T mutations/SNPs, particularly one or more pathogenic G-to-A or C-to-T mutations/SNPs present in at least one gene selected from GAA, AGL, PHKB, PRKAG2, G6PC, PGAM2, GBE1, PYGM, and PFKM, and more particularly one or more pathogenic G-to-A or C-to-T mutations/SNPs described above.

Cystic Fibrosis

In some embodiments, the methods, systems, and compositions described herein are used to correct one or more pathogenic G-to-A or C-to-T mutations/SNPs associated with Cystic Fibrosis. In some embodiment, the pathogenic mutations/SNPs are present in the CFTR gene, including at least the followings:

NM_000492.3(CFTR):c.3712C>T (p.Gln1238Ter)
NM_000492.3(CFTR):c.3484C>T (p.Arg1162Ter)
NM_000492.3(CFTR):c.1766+1G>A
NM_000492.3(CFTR):c.1477C>T (p.Gln493Ter)
NM_000492.3(CFTR):c.2538G>A (p.Trp846Ter)
NM_000492.3(CFTR):c.2551C>T (p.Arg851Ter)
NM_000492.3(CFTR):c.3472C>T (p.Arg1158Ter)
NM_000492.3(CFTR):c.1475C>T (p.Ser492Phe)
NM_000492.3(CFTR):c.1679G>A (p.Arg560Lys)
NM_000492.3(CFTR):c.3197G>A (p.Arg1066His)
NM_000492.3(CFTR):c.3873+1G>A
NM_000492.3(CFTR):c.3196C>T (p.Arg1066Cys)
NM_000492.3(CFTR):c.2490+1G>A
NM_000492.3(CFTR):c.3718-1G>A
NM_000492.3(CFTR):c.171G>A (p.Trp57Ter)
NM_000492.3(CFTR):c.3937C>T (p.Gln1313Ter)
NM_000492.3(CFTR):c.274G>A (p.Glu92Lys)
NM_000492.3(CFTR):c.1013C>T (p.Thr338Ile)
NM_000492.3(CFTR):c.3266G>A (p.Trp1089Ter)
NM_000492.3(CFTR):c.1055G>A (p.Arg352Gln)
NM_000492.3(CFTR):c.1654C>T (p.Gln552Ter)
NM_000492.3(CFTR):c.2668C>T (p.Gln890Ter)
NM_000492.3(CFTR):c.3611G>A (p.Trp1204Ter)
NM_000492.3(CFTR):c.1585-8G>A
NM_000492.3(CFTR):c.223C>T (p.Arg75Ter)
NM_000492.3(CFTR):c.1680-1G>A
NM_000492.3(CFTR):c.349C>T (p.Arg117Cys)
NM_000492.3(CFTR):c.1203G>A (p.Trp401Ter)
NM_000492.3(CFTR):c.1240C>T (p.Gln414Ter)
NM_000492.3(CFTR):c.1202G>A (p.Trp401Ter)
NM_000492.3(CFTR):c.1209+1G>A
NM_000492.3(CFTR):c.115C>T (p.Gln39Ter)
NM_000492.3(CFTR):c.1116+1G>A
NM_000492.3(CFTR):c.1393-1G>A
NM_000492.3(CFTR):c.1573C>T (p.Gln525Ter)
NM_000492.3(CFTR):c.164+1G>A
NM_000492.3(CFTR):c.166G>A (p.Glu56Lys)
NM_000492.3(CFTR):c.170G>A (p.Trp57Ter)
NM_000492.3(CFTR):c.2053C>T (p.Gln685Ter)
NM_000492.3(CFTR):c.2125C>T (p.Arg709Ter)
NM_000492.3(CFTR):c.2290C>T (p.Arg764Ter)
NM_000492.3(CFTR):c.2353C>T (p.Arg785Ter)
NM_000492.3(CFTR):c.2374C>T (p.Arg792Ter)
NM_000492.3(CFTR):c.2537G>A (p.Trp846Ter)
NM_000492.3(CFTR):c.292C>T (p.Gln98Ter)
NM_000492.3(CFTR):c.2989-1G>A

NM_000492.3(CFTR):c.3293G>A (p.Trp1098Ter)
NM_000492.3(CFTR):c.4144C>T (p.Gln1382Ter)
NM_000492.3(CFTR):c.4231C>T (p.Gln1411Ter)
NM_000492.3(CFTR):c.4234C>T (p.Gln1412Ter)
NM_000492.3(CFTR):c.579+5G>A
NM_000492.3(CFTR):c.595C>T (p.His199Tyr)
NM_000492.3(CFTR):c.613C>T (p.Pro205Ser)
NM_000492.3(CFTR):c.658C>T (p.Gln220Ter)
NM_000492.3(CFTR):c.1117-1G>A
NM_000492.3(CFTR):c.3294G>A (p.Trp1098Ter)
NM_000492.3(CFTR):c.1865G>A (p.Gly622Asp)
NM_000492.3(CFTR):c.743+1G>A
NM_000492.3(CFTR):c.1679+1G>A
NM_000492.3(CFTR):c.1657C>T (p.Arg553Ter)
NM_000492.3(CFTR):c.1675G>A (p.Ala559Thr)
NM_000492.3(CFTR):c.165-1G>A
NM_000492.3(CFTR):c.200C>T (p.Pro67Leu)
NM_000492.3(CFTR):c.2834C>T (p.Ser945Leu)
NM_000492.3(CFTR):c.3846G>A (p.Trp1282Ter)
NM_000492.3(CFTR):c.1652G>A (p.Gly551Asp)
NM_000492.3(CFTR):c.4426C>T (p.Gln1476Ter)
NM_000492.3:c.3718-2477C>T
NM_000492.3(CFTR):c.2988+1G>A
NM_000492.3(CFTR):c.2657+5G>A
NM_000492.3(CFTR):c.2988G>A (p.Gln996=)
NM_000492.3(CFTR):c.274-1G>A
NM_000492.3(CFTR):c.3612G>A (p.Trp1204Ter)
NM_000492.3(CFTR):c.1646G>A (p.Ser549Asn)
NM_000492.3(CFTR):c.3752G>A (p.Ser1251Asn)
NM_000492.3(CFTR):c.4046G>A (p.Gly1349Asp)
NM_000492.3(CFTR):c.532G>A (p.Gly178Arg)
NM_000492.3(CFTR):c.3731G>A (p.Gly1244Glu)
NM_000492.3(CFTR):c.1651G>A (p.Gly551Ser)
NM_000492.3(CFTR):c.1585-1G>A
NM_000492.3(CFTR):c.1000C>T (p.Arg334Trp)
NM_000492.3(CFTR):c.254G>A (p.Gly85Glu)
NM_000492.3(CFTR):c.1040G>A (p.Arg347His)
NM_000492.3(CFTR):c.273+1G>A

See Table A. Accordingly, an aspect of the invention relates to a method for treating or preventing Cystic Fibrosis by correcting one or more pathogenic G-to-A or C-to-T mutations/SNPs, particularly one or more pathogenic G-to-A or C-to-T mutations/SNPs present in the CFTR gene, and more particularly one or more pathogenic G-to-A or C-to-T mutations/SNPs described above.

In some embodiments, the methods, systems, and compositions described herein are used to correct a pathogenic A-to-G (A>G) mutation or SNP believed to be associated with familial 2 breast-ovarian cancer, wherein the pathogenic A>G mutation or SNP is located in the BRCA2 gene (HGVS: U43746.1:n.7829+1G>A). Accordingly, an additional aspect of the invention relates to a method for treating or preventing familial 2 breast-ovarian cancer by correcting the aforementioned pathogenic A>G mutation or SNP.

In some embodiments, the methods, systems, and compositions described herein are used to correct a pathogenic A-to-G (A>G) mutation or SNP believed to be associated with hereditary factor IX deficiency, wherein the pathogenic A>G mutation or SNP is located at GRCh38: ChrX: 139537145 in the F9 gene, which results in an Arg to Gln substitution. Accordingly, an additional aspect of the invention relates to a method for treating or preventing hereditary factor IX deficiency by correcting the aforementioned pathogenic A>G mutation or SNP.

In some embodiments, the methods, systems, and compositions described herein are used to correct a pathogenic A-to-G (A>G) mutation or SNP believed to be associated with beta-plus-thalassemia, beta thalassemia, and beta thalassemia major, wherein the pathogenic A>G mutation or SNP is located at GRCh38: Chr11: 5226820 in the HBB gene. Accordingly, an additional aspect of the invention relates to a method for treating or preventing with beta-plus-thalassemia, beta thalassemia, and beta thalassemia major by correcting the aforementioned pathogenic A>G mutation or SNP.

In some embodiments, the methods, systems, and compositions described herein are used to correct a pathogenic A-to-G (A>G) mutation or SNP believed to be associated with Marfan syndrome, wherein the pathogenic A>G mutation or SNP is located in the FBN1 gene (IVS2DS, G-A, +1), as reported by Yamamoto et al. J Hum Genet. 2000; 45(2): 115-8. Accordingly, an additional aspect of the invention relates to a method for treating or preventing Marfan syndrome by correcting the aforementioned pathogenic A>G mutation or SNP.

In some embodiments, the methods, systems, and compositions described herein are used to correct a pathogenic A-to-G (A>G) mutation or SNP believed to be associated with Wiskott-Aldrich syndrome, wherein the pathogenic A>G mutation or SNP is located at position −1 of intro 6 of the WAS gene (IVS6AS, G-A, −1), as reported by Kwan et al. (1995). Accordingly, an additional aspect of the invention relates to a method for treating or preventing Wiskott-Aldrich syndrome by correcting the aforementioned pathogenic A>G mutation or SNP.

In some embodiments, the methods, systems, and compositions described herein are used to correct a pathogenic A-to-G (A>G) mutation or SNP believed to be associated with cystic fibrosis, wherein the pathogenic A>G mutation or SNP is located at GRCh38: Chr7:117590440 in the CFTR gene. Accordingly, an additional aspect of the invention relates to a method for treating or preventing cystic fibrosis by correcting the aforementioned pathogenic A>G mutation or SNP.

In some embodiments, the methods, systems, and compositions described herein are used to correct a pathogenic A-to-G (A>G) mutation or SNP believed to be associated with cystic fibrosis and hereditary pancreatitis, wherein the pathogenic A>G mutation or SNP is located GRCh38: Chr7:117606754 in the CFTR gene. Accordingly, an additional aspect of the invention relates to a method for treating or preventing cystic fibrosis and hereditary pancreatitis by correcting the aforementioned pathogenic A>G mutation or SNP.

In some embodiments, the methods, systems, and compositions described herein are used to correct a pathogenic A-to-G (A>G) mutation or SNP believed to be associated with cystic fibrosis, wherein the pathogenic A>G mutation or SNP is located at GRCh38: Chr7: 117587738 in the CFTR gene. Accordingly, an additional aspect of the invention relates to a method for treating or preventing cystic fibrosis by correcting the aforementioned pathogenic A>G mutation or SNP.

In some embodiments, the methods, systems, and compositions described herein are used to correct a pathogenic A-to-G (A>G) mutation or SNP believed to be associated with Turcot syndrome and Lynch syndrome, wherein the pathogenic A>G mutation or SNP is located at GRCh38: Chr2:47470964 in the MSH2 gene. Accordingly, an additional aspect of the invention relates to a method for treating or preventing Turcot syndrome and Lynch syndrome by correcting the aforementioned pathogenic A>G mutation or SNP.

In some embodiments, the methods, systems, and compositions described herein are used to correct a pathogenic A-to-G (A>G) mutation or SNP believed to be associated with cystic fibrosis, wherein the pathogenic A>G mutation or SNP is located at GRCh38: Chr7: 117642437 in the CFTR gene. Accordingly, an additional aspect of the invention relates to a method for treating or preventing cystic fibrosis by correcting the aforementioned pathogenic A>G mutation or SNP.

In some embodiments, the methods, systems, and compositions described herein are used to correct a pathogenic A-to-G (A>G) mutation or SNP believed to be associated with Lynch syndrome II and Lynch syndrome, wherein the pathogenic A>G mutation or SNP is located at GRCh38: Chr3:37001058 in the MLH1 gene. Accordingly, an additional aspect of the invention relates to a method for treating or preventing Lynch syndrome II and Lynch syndrome by correcting the aforementioned pathogenic A>G mutation or SNP.

In some embodiments, the methods, systems, and compositions described herein are used to correct a pathogenic A-to-G (A>G) mutation or SNP believed to be associated with cystic fibrosis, wherein the pathogenic A>G mutation or SNP is located at GRCh38: Chr7: 117642594 in the CFTR gene. Accordingly, an additional aspect of the invention relates to a method for treating or preventing cystic fibrosis by correcting the aforementioned pathogenic A>G mutation or SNP.

In some embodiments, the methods, systems, and compositions described herein are used to correct a pathogenic A-to-G (A>G) mutation or SNP believed to be associated with cystic fibrosis, wherein the pathogenic A>G mutation or SNP is located at GRCh38: Chr7: 117592658 in the CFTR gene. Accordingly, an additional aspect of the invention relates to a method for treating or preventing cystic fibrosis by correcting the aforementioned pathogenic A>G mutation or SNP.

In some embodiments, the methods, systems, and compositions described herein are used to correct a pathogenic A-to-G (A>G) mutation or SNP believed to be associated with familial 1 breast-ovarian cancer, hereditary breast and ovarian cancer syndrome, and hereditary cancer-predisposing syndrome, wherein the pathogenic A>G mutation or SNP is located at GRCh38: Chr17:43057051 in the BRCA1 gene. Accordingly, an additional aspect of the invention relates to a method for treating or preventing familial 1 breast-ovarian cancer, hereditary breast and ovarian cancer syndrome, and hereditary cancer-predisposing syndrome by correcting the aforementioned pathogenic A>G mutation or SNP.

In some embodiments, the methods, systems, and compositions described herein are used to correct a pathogenic A-to-G (A>G) mutation or SNP believed to be associated with dihydropyrimidine dehydrogenase deficiency, Hirschsprung disease 1, fluorouracil response, pyrimidine analogues response-toxicity/ADR, capecitabine response-toxicity/ADR, fluorouracil response-toxicity/ADR, tegafur response-toxicity/ADR, wherein the pathogenic A>G mutation or SNP is located at GRCh38: Chr1:97450058 in the DPYD gene. Accordingly, an additional aspect of the invention relates to a method for treating or preventing dihydropyrimidine dehydrogenase deficiency, Hirschsprung disease 1, fluorouracil response, pyrimidine analogues response-toxicity/ADR, capecitabine response-toxicity/ADR, fluorouracil response-toxicity/ADR, tegafur response-toxicity/ADR by correcting the aforementioned pathogenic A>G mutation or SNP.

In some embodiments, the methods, systems, and compositions described herein are used to correct a pathogenic A-to-G (A>G) mutation or SNP believed to be associated with Lynch syndrome, wherein the pathogenic A>G mutation or SNP is located at GRCh38: Chr2:47478520 in the MSH2 gene. Accordingly, an additional aspect of the invention relates to a method for treating or preventing the Lynch syndrome by correcting the aforementioned pathogenic A>G mutation or SNP.

In some embodiments, the methods, systems, and compositions described herein are used to correct a pathogenic A-to-G (A>G) mutation or SNP believed to be associated with Lynch syndrome, wherein the pathogenic A>G mutation or SNP is located at GRCh38: Chr3:37011819 in the MLH1 gene. Accordingly, an additional aspect of the invention relates to a method for treating or preventing the Lynch syndrome by correcting the aforementioned pathogenic A>G mutation or SNP.

In some embodiments, the methods, systems, and compositions described herein are used to correct a pathogenic A-to-G (A>G) mutation or SNP believed to be associated with Lynch syndrome, wherein the pathogenic A>G mutation or SNP is located at GRCh38: Chr3: 37014545 in the MLH1 gene. Accordingly, an additional aspect of the invention relates to a method for treating or preventing the Lynch syndrome by correcting the aforementioned pathogenic A>G mutation or SNP.

In some embodiments, the methods, systems, and compositions described herein are used to correct a pathogenic A-to-G (A>G) mutation or SNP believed to be associated with Lynch syndrome, wherein the pathogenic A>G mutation or SNP is located at GRCh38: Chr3: 37011867 in the MLH1 gene. Accordingly, an additional aspect of the invention relates to a method for treating or preventing the Lynch syndrome by correcting the aforementioned pathogenic A>G mutation or SNP.

In some embodiments, the methods, systems, and compositions described herein are used to correct a pathogenic A-to-G (A>G) mutation or SNP believed to be associated with Lynch syndrome, wherein the pathogenic A>G mutation or SNP is located at GRCh38: Chr3: 37025636 in the MLH1 gene. Accordingly, an additional aspect of the invention relates to a method for treating or preventing the Lynch syndrome by correcting the aforementioned pathogenic A>G mutation or SNP.

In some embodiments, the methods, systems, and compositions described herein are used to correct a pathogenic A-to-G (A>G) mutation or SNP believed to be associated with Lynch syndrome, wherein the pathogenic A>G mutation or SNP is located at GRCh38: Chr3: 37004475 in the MLH1 gene. Accordingly, an additional aspect of the invention relates to a method for treating or preventing the Lynch syndrome by correcting the aforementioned pathogenic A>G mutation or SNP.

In some embodiments, the methods, systems, and compositions described herein are used to correct a pathogenic A-to-G (A>G) mutation or SNP believed to be associated with Lynch syndrome and hereditary cancer-predisposing syndrome, wherein the pathogenic A>G mutation or SNP is located at GRCh38: Chr2:47416430 in the MSH2 gene. Accordingly, an additional aspect of the invention relates to a method for treating or preventing Lynch syndrome and hereditary cancer-predisposing syndrome by correcting the aforementioned pathogenic A>G mutation or SNP.

In some embodiments, the methods, systems, and compositions described herein are used to correct a pathogenic A-to-G (A>G) mutation or SNP believed to be associated with Lynch syndrome and hereditary cancer-predisposing syndrome, wherein the pathogenic A>G mutation or SNP is located at GRCh38: Chr2: 47408400 in the MSH2 gene. Accordingly, an additional aspect of the invention relates to a method for treating or preventing Lynch syndrome and hereditary cancer-predisposing syndrome by correcting the aforementioned pathogenic A>G mutation or SNP.

In some embodiments, the methods, systems, and compositions described herein are used to correct a pathogenic A-to-G (A>G) mutation or SNP believed to be associated with Lynch syndrome and hereditary cancer-predisposing syndrome, wherein the pathogenic A>G mutation or SNP is located at GRCh38: Chr3:36996710 in the MLH1 gene. Accordingly, an additional aspect of the invention relates to a method for treating or preventing Lynch syndrome and hereditary cancer-predisposing syndrome by correcting the aforementioned pathogenic A>G mutation or SNP.

In some embodiments, the methods, systems, and compositions described herein are used to correct a pathogenic A-to-G (A>G) mutation or SNP believed to be associated with familial 1 breast-ovarian cancer, wherein the pathogenic A>G mutation or SNP is located at GRCh38: Chr17: 43067696 in the BRCA1 gene. Accordingly, an additional aspect of the invention relates to a method for treating or preventing familial 1 breast-ovarian cancer by correcting the aforementioned pathogenic A>G mutation or SNP.

In some embodiments, the methods, systems, and compositions described herein are used to correct a pathogenic A-to-G (A>G) mutation or SNP believed to be associated with familial 2 breast-ovarian cancer and hereditary breast and ovarian cancer syndrome, wherein the pathogenic A>G mutation or SNP is located at GRCh38: Chr13:32356610 in the BRCA2 gene. Accordingly, an additional aspect of the invention relates to a method for treating or preventing familial 2 breast-ovarian cancer and hereditary breast and ovarian cancer syndrome by correcting the aforementioned pathogenic A>G mutation or SNP.

In some embodiments, the methods, systems, and compositions described herein are used to correct a pathogenic A-to-G (A>G) mutation or SNP believed to be associated with primary dilated cardiomyopathy and primary familial hypertrophic cardiomyopathy, wherein the pathogenic A>G mutation or SNP is located at GRCh38: Chr14:23419993 in the MYH7 gene. Accordingly, an additional aspect of the invention relates to a method for treating or preventing primary dilated cardiomyopathy and primary familial hypertrophic cardiomyopathy by correcting the aforementioned pathogenic A>G mutation or SNP.

In some embodiments, the methods, systems, and compositions described herein are used to correct a pathogenic A-to-G (A>G) mutation or SNP believed to be associated with primary familial hypertrophic cardiomyopathy, camptocormism, and hypertrophic cardiomyopathy, wherein the pathogenic A>G mutation or SNP is located at GRCh38: Chr14:23415225 in the MYH7 gene. Accordingly, an additional aspect of the invention relates to a method for treating or preventing primary familial hypertrophic cardiomyopathy, camptocormism, and hypertrophic cardiomyopathy by correcting the aforementioned pathogenic A>G mutation or SNP.

In some embodiments, the methods, systems, and compositions described herein are used to correct a pathogenic A-to-G (A>G) mutation or SNP believed to be associated with familial cancer of breast, familial 2 breast-ovarian cancer, hereditary breast and ovarian cancer syndrome, and hereditary cancer-predisposing syndrome, wherein the pathogenic A>G mutation or SNP is located at GRCh38: Chr13:32357741 in the BRCA2 gene. Accordingly, an additional aspect of the invention relates to a method for treating or preventing the familial cancer of breast, familial 2 breast-ovarian cancer, hereditary breast and ovarian cancer syndrome, and hereditary cancer-predisposing syndrome by correcting the aforementioned pathogenic A>G mutation or SNP.

In some embodiments, the methods, systems, and compositions described herein are used to correct a pathogenic A-to-G (A>G) mutation or SNP believed to be associated with primary dilated cardiomyopathy, hypertrophic cardiomyopathy, cardiomyopathy, and left ventricular noncompaction, wherein the pathogenic A>G mutation or SNP is located at GRCh38: Chr14:23431584 in the MYH7 gene. Accordingly, an additional aspect of the invention relates to a method for treating or preventing primary dilated cardiomyopathy, hypertrophic cardiomyopathy, cardiomyopathy, and left ventricular noncompaction by correcting the aforementioned pathogenic A>G mutation or SNP.

In some embodiments, the methods, systems, and compositions described herein are used to correct a pathogenic A-to-G (A>G) mutation or SNP believed to be associated with familial 1 breast-ovarian cancer, hereditary breast and ovarian cancer syndrome, and hereditary cancer-predisposing syndrome, wherein the pathogenic A>G mutation or SNP is located at GRCh38: Chr17:43067607 in the BRCA1 gene. Accordingly, an additional aspect of the invention relates to a method for treating or preventing familial 1 breast-ovarian cancer, hereditary breast and ovarian cancer syndrome, and hereditary cancer-predisposing syndrome by correcting the aforementioned pathogenic A>G mutation or SNP.

In some embodiments, the methods, systems, and compositions described herein are used to correct a pathogenic A-to-G (A>G) mutation or SNP believed to be associated with familial 1 breast-ovarian cancer, hereditary breast and ovarian cancer syndrome, hereditary cancer-predisposing syndrome, and breast cancer, wherein the pathogenic A>G mutation or SNP is located at GRCh38: Chr17:43047666 in the BRCA1 gene. Accordingly, an additional aspect of the invention relates to a method for treating or preventing familial 1 breast-ovarian cancer, hereditary breast and ovarian cancer syndrome, hereditary cancer-predisposing syndrome, and breast cancer by correcting the aforementioned pathogenic A>G mutation or SNP.

In some embodiments, the methods, systems, and compositions described herein are used to correct a pathogenic A-to-G (A>G) mutation or SNP believed to be associated with familial 2 breast-ovarian cancer, hereditary breast and ovarian cancer syndrome, and hereditary cancer-predisposing syndrome, wherein the pathogenic A>G mutation or SNP is located at GRCh38: Chr13:32370558 in the BRCA2 gene. Accordingly, an additional aspect of the invention relates to a method for treating or preventing familial 2 breast-ovarian cancer, hereditary breast and ovarian cancer syndrome, and hereditary cancer-predisposing syndrome by correcting the aforementioned pathogenic A>G mutation or SNP.

In some embodiments, the methods, systems, and compositions described herein are used to correct a pathogenic A-to-G (A>G) mutation or SNP believed to be associated with familial 1 breast-ovarian cancer, hereditary breast and ovarian cancer syndrome, hereditary cancer-predisposing syndrome, and breast cancer, wherein the pathogenic A>G mutation or SNP is located at GRCh38: Chr17:43074330 in the BRCA1 gene. Accordingly, an additional aspect of the invention relates to a method for treating or preventing familial 1 breast-ovarian cancer, hereditary breast and ovarian cancer syndrome, hereditary cancer-predisposing syndrome, and breast cancer by correcting the aforementioned pathogenic A>G mutation or SNP.

In some embodiments, the methods, systems, and compositions described herein are used to correct a pathogenic A-to-G (A>G) mutation or SNP believed to be associated with familial 1 breast-ovarian cancer, hereditary breast and ovarian cancer syndrome, and hereditary cancer-predisposing syndrome, wherein the pathogenic A>G mutation or SNP is located at GRCh38: Chr17: 43082403 in the BRCA1 gene. Accordingly, an additional aspect of the invention relates to a method for treating or preventing familial 1 breast-ovarian cancer, hereditary breast and ovarian cancer syndrome, and hereditary cancer-predisposing syndrome by correcting the aforementioned pathogenic A>G mutation or SNP.

In some embodiments, the methods, systems, and compositions described herein are used to correct a pathogenic C-to-T (C>T) mutation or SNP believed to be associated with cystic fibrosis and hereditary pancreatitis, wherein the pathogenic C>T mutation or SNP is located at GRCh38: Chr7:117639961 in the CFTR gene. Accordingly, an additional aspect of the invention relates to a method for treating or preventing the cystic fibrosis and hereditary pancreatitis by correcting the aforementioned pathogenic C>T mutation or SNP.

In some embodiments, the methods, systems, and compositions described herein are used to correct a pathogenic C-to-T (C>T) mutation or SNP believed to be associated with familial 2 breast-ovarian cancer, wherein the pathogenic C>T mutation or SNP is located at GRCh38: Chr13: 32336492 in the BRCA2 gene. Accordingly, an additional aspect of the invention relates to a method for treating or preventing the familial 2 breast-ovarian cancer by correcting the aforementioned pathogenic C>T mutation or SNP.

In some embodiments, the methods, systems, and compositions described herein are used to correct a pathogenic C-to-T (C>T) mutation or SNP believed to be associated with familial 1 breast-ovarian cancer, wherein the pathogenic C>T mutation or SNP is located at GRCh38: Chr17: 43063365 in the BRCA1 gene. Accordingly, an additional aspect of the invention relates to a method for treating or preventing the familial 1 breast-ovarian cancer by correcting the aforementioned pathogenic C>T mutation or SNP.

In some embodiments, the methods, systems, and compositions described herein are used to correct a pathogenic C-to-T (C>T) mutation or SNP believed to be associated with familial 1 breast-ovarian cancer, wherein the pathogenic C>T mutation or SNP is located at GRCh38: Chr17: 43093613 in the BRCA1 gene. Accordingly, an additional aspect of the invention relates to a method for treating or preventing the familial 1 breast-ovarian cancer by correcting the aforementioned pathogenic C>T mutation or SNP.

In some embodiments, the methods, systems, and compositions described herein are used to correct a pathogenic C-to-T (C>T) mutation or SNP believed to be associated with familial cancer of breast, and familial 1 breast-ovarian cancer, wherein the pathogenic C>T mutation or SNP is located at GRCh38: Chr17:43093931 of the BRCA1 gene. Accordingly, an additional aspect of the invention relates to a method for treating or preventing familial cancer of breast, and familial 1 breast-ovarian cancer by correcting the aforementioned pathogenic C>T mutation or SNP.

In some embodiments, the methods, systems, and compositions described herein are used to correct a pathogenic C-to-T (C>T) mutation or SNP believed to be associated with familial hypertrophic cardiomyopathy 1, primary familial hypertrophic cardiomyopathy, and hypertrophic cardiomyopathy, wherein the pathogenic C>T mutation or SNP is located at GRCh38: Chr14:23429279 of the MYH7 gene. Accordingly, an additional aspect of the invention relates to a method for treating or preventing familial hypertrophic cardiomyopathy 1, primary familial hypertrophic cardiomyopathy, and hypertrophic cardiomyopathy by correcting the aforementioned pathogenic C>T mutation or SNP.

In some embodiments, the methods, systems, and compositions described herein are used to correct a pathogenic C-to-T (C>T) mutation or SNP believed to be associated with familial 2 breast-ovarian cancer, hereditary breast and ovarian cancer syndrome, and hereditary cancer-predisposing syndrome, wherein the pathogenic C>T mutation or SNP is located at GRCh38: Chr13:32356472 of the BRCA2 gene. Accordingly, an additional aspect of the invention relates to a method for treating or preventing familial 2 breast-ovarian cancer, hereditary breast and ovarian cancer syndrome, and hereditary cancer-predisposing syndrome by correcting the aforementioned pathogenic C>T mutation or SNP.

In some embodiments, the methods, systems, and compositions described herein are used to correct a pathogenic C-to-T (C>T) mutation or SNP believed to be associated with familial hypertrophic cardiomyopathy 1, primary familial hypertrophic cardiomyopathy, familial restrictive cardiomyopathy, and hypertrophic cardiomyopathy, wherein the pathogenic C>T mutation or SNP is located at GRCh38: Chr14:23429005 in the MYH7 gene. Accordingly, an additional aspect of the invention relates to a method for treating or preventing familial hypertrophic cardiomyopathy 1, primary familial hypertrophic cardiomyopathy, familial restrictive cardiomyopathy, and hypertrophic cardiomyopathy by correcting the aforementioned pathogenic C>T mutation or SNP.

Additional pathogenic A>G mutations and SNPs are found in the ClinVar database Accordingly, an additional aspect of the present disclosure relates to correction of a pathogenic A>G mutation or SNP listed in ClinVar using the methods, systems, and compositions described herein to treat or prevent a disease or condition associated therewith.

Additional pathogenic C>T mutations and SNPs are also found in the ClinVar database. Accordingly, an additional aspect of the present disclosure relates to correction of a pathogenic C>T mutation or SNP listed in ClinVar using the methods, systems, and compositions described herein to treat or prevent a disease or condition associated therewith. Other T mutations or SNPS that may be addressed using the embodiments disclosed herein are listed in a table found in the ASCII text filed entitled "Clin_var_pathogenic_SNP-S_TC_txt" filed herewith.

The invention is further described in the following examples, which do not limit the scope of the invention described in the claims.

EXAMPLES

Example 1

Adenine deaminases (ADs) is capable of deaminating adenines at specific sites in double stranded RNA.

The facts that some ADs can effect adenine deamination on DNA-RNAn RNA duplexes (e.g. Zheng et al., Nucleic Acids Research 2017) presents a unique opportunity to develop an RNA guided AD by taking advantage of the RNA duplex formed between the guide RNA and its complementary DNA target in the R-loop formed during RNA-guided DNA binding by inactive Cas13. By using inactive Cas13 to recruit an AD, the AD enzyme will then act on the adenine in the RNA-DNAn RNA duplex.

In one embodiment, an inactive Cas13, such as Cas13b is obtained using the following mutations: R116A, H121A, R1177A and H1182A. To increase the efficiency of editing by AD, a mutated ADAR is used such as the mutated hADAR2d comprising mutation E488Q.

Designs for the Recruitment of AD to a Specific Locus:
1. NLS-tagged inactive Cas13 is fused to AD on either the N- or C-terminal end. A variety of linkers are used including flexible linkers such as GSG5 or less flexible linkers such as LEPGEKPYKCPECGKSFSQSGAL-TRHQRTHTR (SEQ ID No. 11).
2. The guide RNA scaffold is modified with aptamers such as MS2 binding sites (e.g. Konermann et al., Nature 2015). NLS-tagged AD-MS2 binding protein fusions is co-introduced into target cells along with (NLS-tagged inactive or Cas13b) and corresponding guide RNA.
3. AD is inserted into an internal loop of NLS-tagged inactive or nickase Cas13.

Designs for the RNA Guide:
1. Guide sequences of a length corresponding to that of a natural guide sequence of the Cas13 protein are designed to target the RNA of interest.
2. RNA guide with longer than canonical length is used to form RNA duplexes outside of the protein-guide RNA-target DNA complex.

For each of these RNA guide designs, the base on the RNA that is opposite of the adenine on the target RNA strand would be specified as a C as opposed to U.

Choice and Designs of ADs:

A number of ADs are used, and each will have varying levels of activity. These ADs
1. Human ADARs (hADAR1, hADAR2, hADAR3)
2. Squid Octopus vulgaris ADARs
3. Squid Sepia ADARS; *Doryteuthis opalescens* ADARS ADATs (human ADAT, *Drosophila* ADAT)

Mutations can also be used to increase the activity of ADAR reacting against a DNA-RNAn RNA duplex. For example, for the human ADAR genes, the hADAR1d (E1008Q) or hADAR2d(E488Q) mutation is used to increase their activity against a DNA-RNA target.

Each ADAR has varying levels of sequence context requirement. For example, for hADAR1d (E1008Q), tAg and aAg sites are efficiently deaminated, whereas aAt and cAc are less efficiently edited, and gAa and gAc are even less edited. However, the context requirement will vary for different ADARs.

A schematic showing of one version of the system is provided in FIG. 1. The amino acid sequences of example AD proteins are provided in FIG. 4.

The embodiments, illustratively described herein may suitably be practiced in the absence of any element or elements, limitation or limitations, not specifically disclosed herein. Thus, for example, the terms "comprising," "including," "containing," etc. shall be read expansively and without limitation. Additionally, the terms and expressions employed herein have been used as terms of description and not of limitation, and there is no intention in the use of such terms and expressions of excluding any equivalents of the features shown and described or portions thereof, but it is recognized that various modifications are possible within the scope of the claimed technology. Additionally, the phrase "consisting essentially of" will be understood to include those elements specifically recited and those additional elements that do not materially affect the basic and novel characteristics of the claimed technology. The phrase "consisting of" excludes any element not specified.

The present disclosure is not to be limited in terms of the particular embodiments described in this application. Many modifications and variations can be made without departing from its spirit and scope, as will be apparent to those skilled in the art. Functionally equivalent methods and compositions within the scope of the disclosure, in addition to those enumerated herein, will be apparent to those skilled in the art from the foregoing descriptions. Such modifications and variations are intended to fall within the scope of the appended claims. The present disclosure is to be limited only by the terms of the appended claims, along with the full scope of equivalents to which such claims are entitled. It is to be understood that this disclosure is not limited to particular methods, reagents, compounds compositions or biological systems, which can of course vary. It is also to be understood that the terminology used herein is for the purpose of describing particular embodiments only, and is not intended to be limiting.

In addition, where features or aspects of the disclosure are described in terms of Markush groups, those skilled in the art will recognize that the disclosure is also thereby described in terms of any individual member or subgroup of members of the Markush group.

As will be understood by one skilled in the art, for any and all purposes, particularly in terms of providing a written description, all ranges disclosed herein also encompass any and all possible subranges and combinations of subranges thereof. Any listed range can be easily recognized as sufficiently describing and enabling the same range being broken down into at least equal halves, thirds, quarters, fifths, tenths, etc. As a non-limiting example, each range discussed herein can be readily broken down into a lower third, middle third and upper third, etc. As will also be understood by one skilled in the art all language such as "up to," "at least," "greater than," "less than," and the like, include the number recited and refer to ranges which can be subsequently broken down into subranges as discussed above. Finally, as will be understood by one skilled in the art, a range includes each individual member.

All publications, patent applications, issued patents, and other documents referred to in this specification are herein incorporated by reference as if each individual publication, patent application, issued patent, or other document was specifically and individually indicated to be incorporated by reference in its entirety. Definitions that are contained in text incorporated by reference are excluded to the extent that they contradict definitions in this disclosure.

Example 2

Cluc/Gluc Tiling for Cas13a/Cas13b Interference

Figure 10:
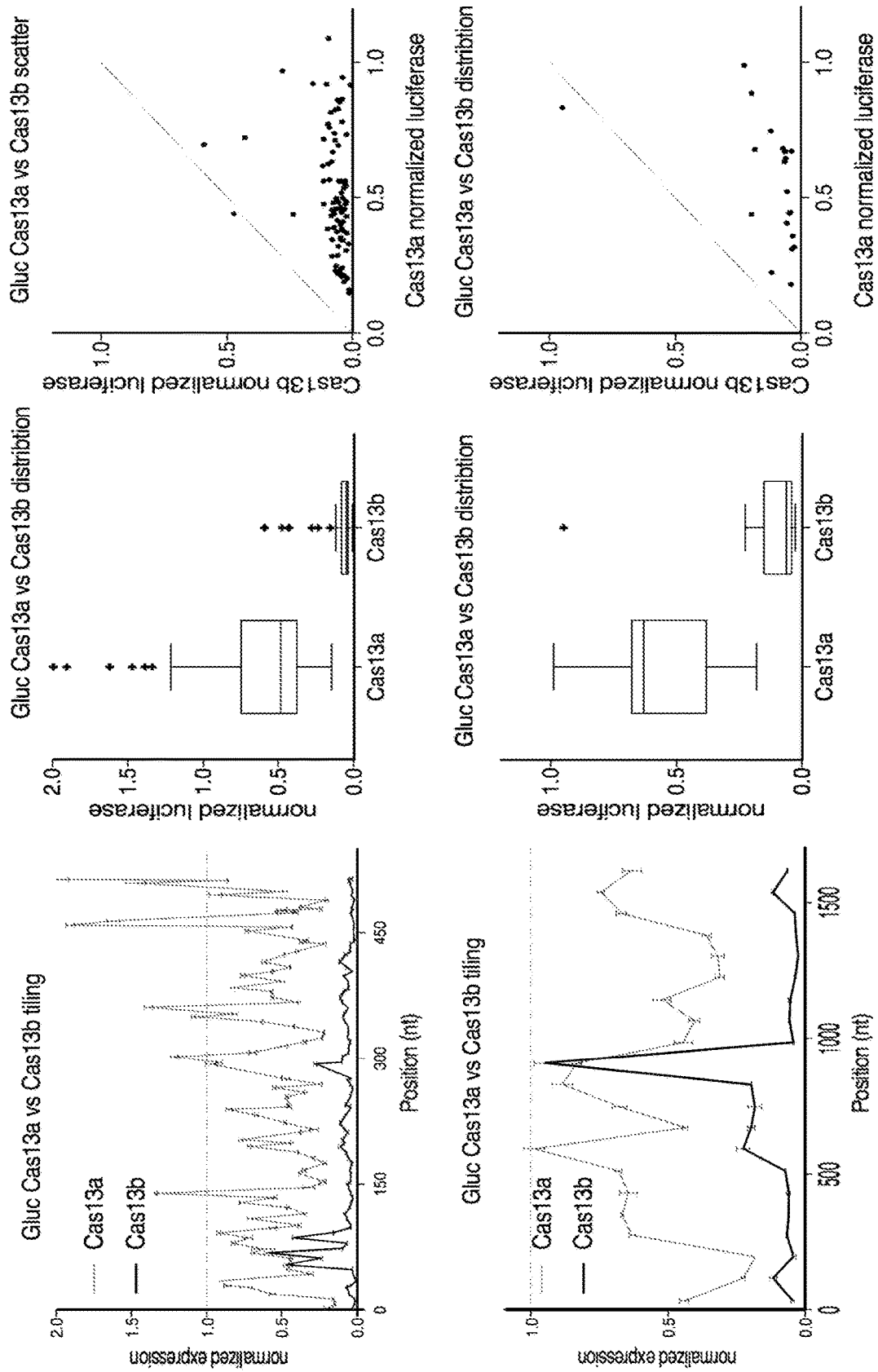
FIG. 10: Cluc/Gluc tiling for Cas13a/Cas13b interference

To compare knockdown efficiency between Cas13a and Cas13b, *Cypridina* and *Gaussia* luciferase genes were tiled with 24 or 96 guides, respectively (FIG. 10). Guides were matched for Cas13a and Cas13b, and show increased knockdown efficiency for Cas13b, with all but one guide for each gene showing higher efficiency for Cas13b.

ADAR Editing Quantification by NGS

Figure 11A:
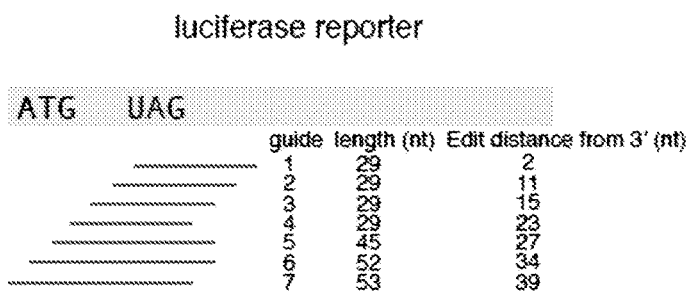
FIGS. 11A-11C: ADAR editing quantification by NGS (luciferase reporter).
Figure 11B:
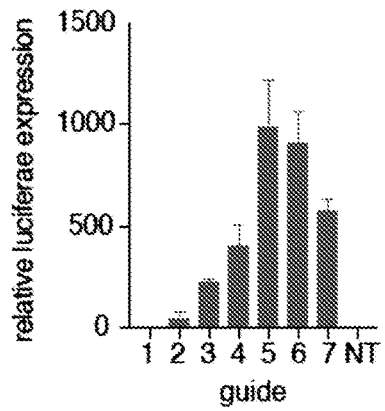

Cas13b-ADAR2 RNA editing efficiency was tested by designing a luciferase reporter with a premature stop codon UAG, which prevents expression of the luciferase (FIGS. 11A-11C). 7 guides of varying length were designed and positioned relative to the UAG stop codon that all contained a C mismatch to the A in the UAG. The C mismatch is known to create a bubble at the site of editing which is favored by the ADAR catalytic domain. RNA editing by Cas13b-ADAR2 would convert the UAG to a UIG (UGG), which introduces a tryptophan instead of the stop codon, and allows translation to proceed. Expression of the guides and Cas13b12-ADAR2 fusion in HEK293FT cells restored luciferase expression to varying levels with the greatest restoration occurring for guide 5 (FIG. 11B). In general, there is increasing levels of editing from guides 1-5 as the editing site is moved further away from the 3' end of the crRNA where the direct repeat is and thus where the protein binds. This likely indicates that the part of the crRNA:target duplex that is bound by the protein is inaccessible to the ADAR catalytic domain. Guides 5, 6, and 7 show the greatest amount of activity because the editing site is on the far end of the guide away from the DR/protein binding area and because their guides are much longer, generating a longer RNA duplex that is favored by ADAR. ADAR activity is optimal when the editing site is in the middle of a RNA duplex. The relative expression of luciferase activity is normalized to the non-targeting guide condition.

Figure 11C:
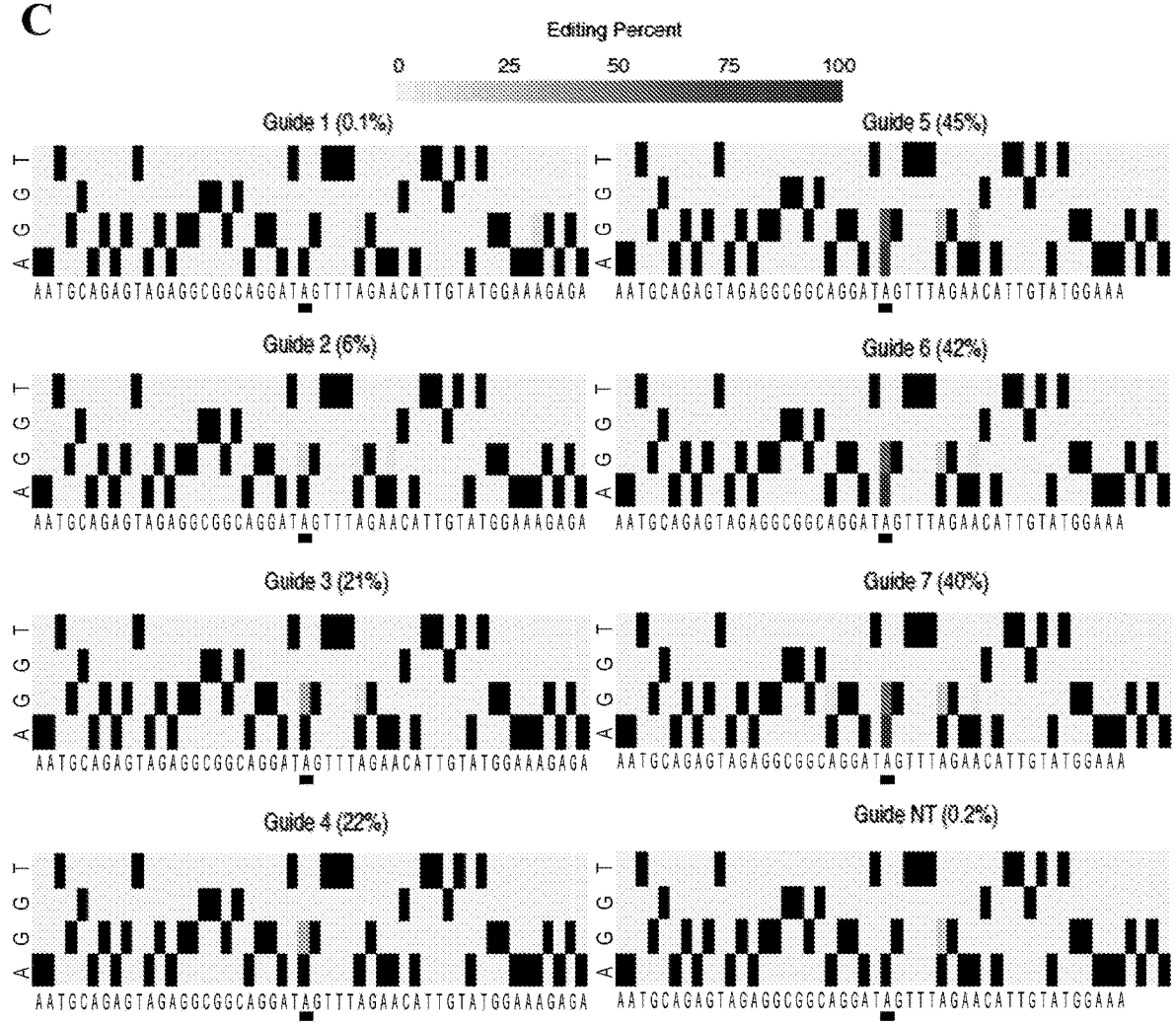

These samples were sequenced to precisely quantitate the RNA editing efficiency (FIG. 11C). The editing efficiency is listed in parentheses next to the guide label. Overall, the percent editing identified by sequencing matched the relative levels of luciferase expression restoration seen in FIG. 111B. Guide 5 showed the most RNA editing with a rate of 45% conversion to G at the on-target A. In some instances, there is a small amount of off-target A-G editing in the region. These may be reduced by introducing G mismatches in the guide sequence, which are disfavored by the ADAR catalytic domain.

Figure 12:
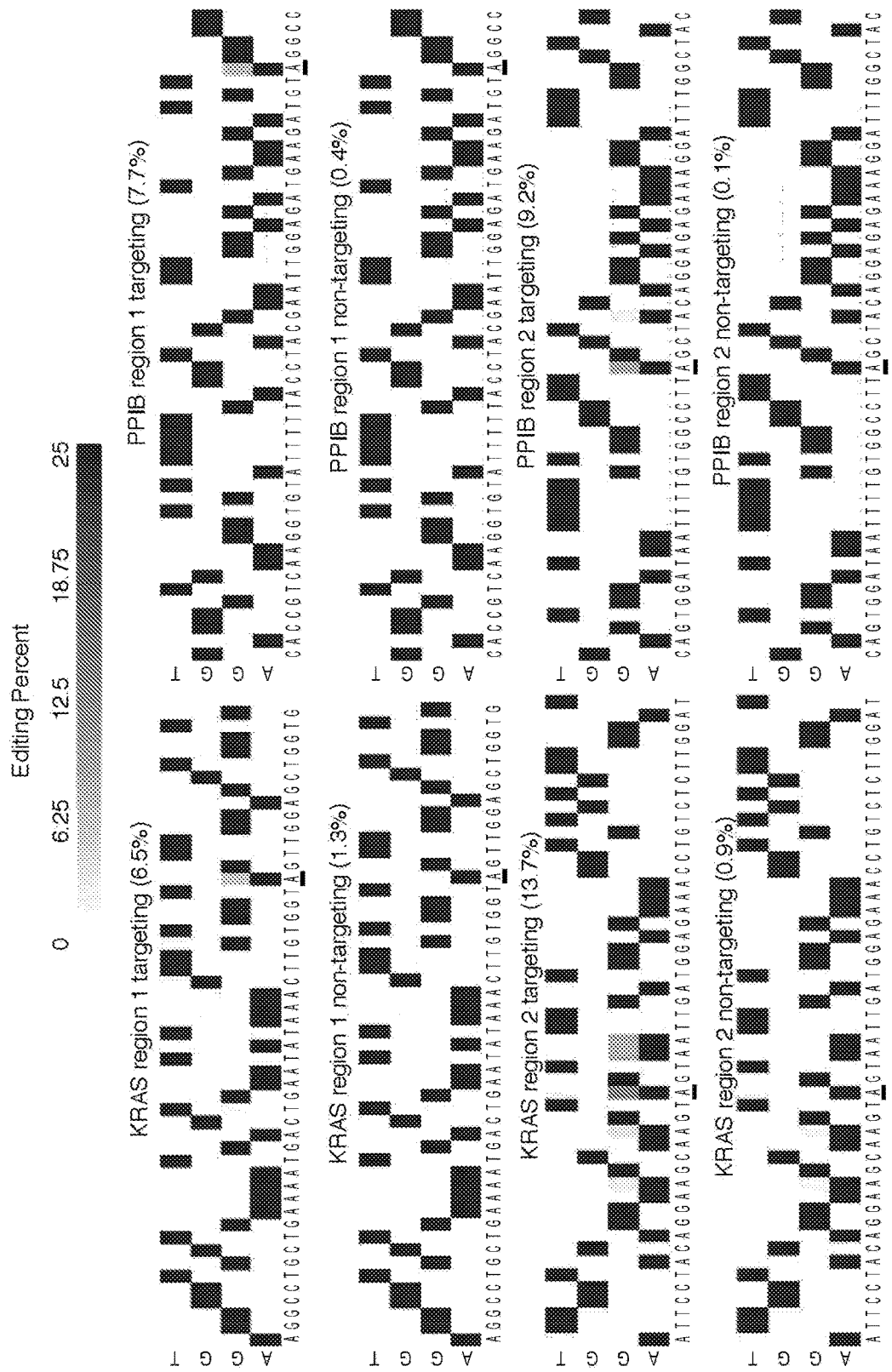
FIG. 12: ADAR editing quantification by NGS (KRAS and PPIB).

In addition to editing the luciferase reporter transcript, guides were designed to edit out-of-frame UAG sites in the KRAS and PPIB transcripts, with two guides targeting each transcript (FIG. 12). The guides were designed with the same principles as guide 5 above (a 45nt spacer with the editing site 27nt away from the 3' DR and a C mismatch to the editing site adenosine). The KRAS guides were able to achieve 6.5% and 13.7% editing at the on-target adenosine and the PPIB guides were able to achieve 7.7% and 9.2% editing. There are also some off-targets present for some of these guides which can be reduced by designing G mismatches in the spacers against possible off-target adenosines that are nearby. It does seem that off-targets seem to happen with the duplex region 3' of the target adenosine.

Cas13a/b+shRNA Specificity from RNA Seq

To determine the specificity of the Cas13b12 knockdown, RNA sequencing was performed on all mRNAs across the transcriptome (FIG. 13A). The knockdown of guides targeting Gluc and KRAS was compared against non-targeting guides and found that Cas13a2 and Cas13b12 had specific knockdown of the target transcript (red dot in FIG. 13A) while the shRNAs had many off-targets as evidenced by the greater variance in the distribution. The number of significant off-targets for each of these conditions is shown in FIG. 13B. Significant off-targets are measured by a t-test with FDR correction (p<0.01) for any off-target transcripts that are changed by greater than 2 fold or less than 0.8 fold. The Cas13a and Cas13b conditions had very few off targets compared to the hundreds of off-targets found for the shRNA conditions. The knockdown efficiency for each of the conditions is shown in FIG. 13C.

Mismatch Specificity to Reduce Off Targets (A:a or A:G)

Figure 14:
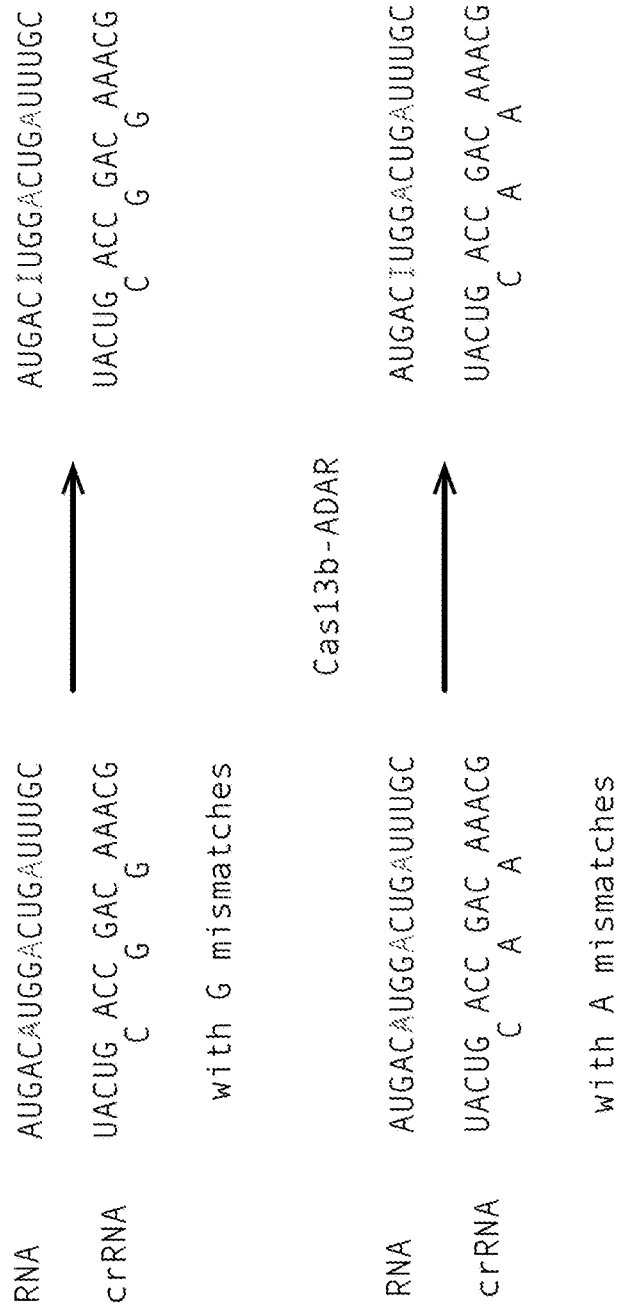
FIG. 14: Mismatch specificity to reduce off targets (A:A or A:G) (SEQ ID Nos. 661-668)
Figure 15:
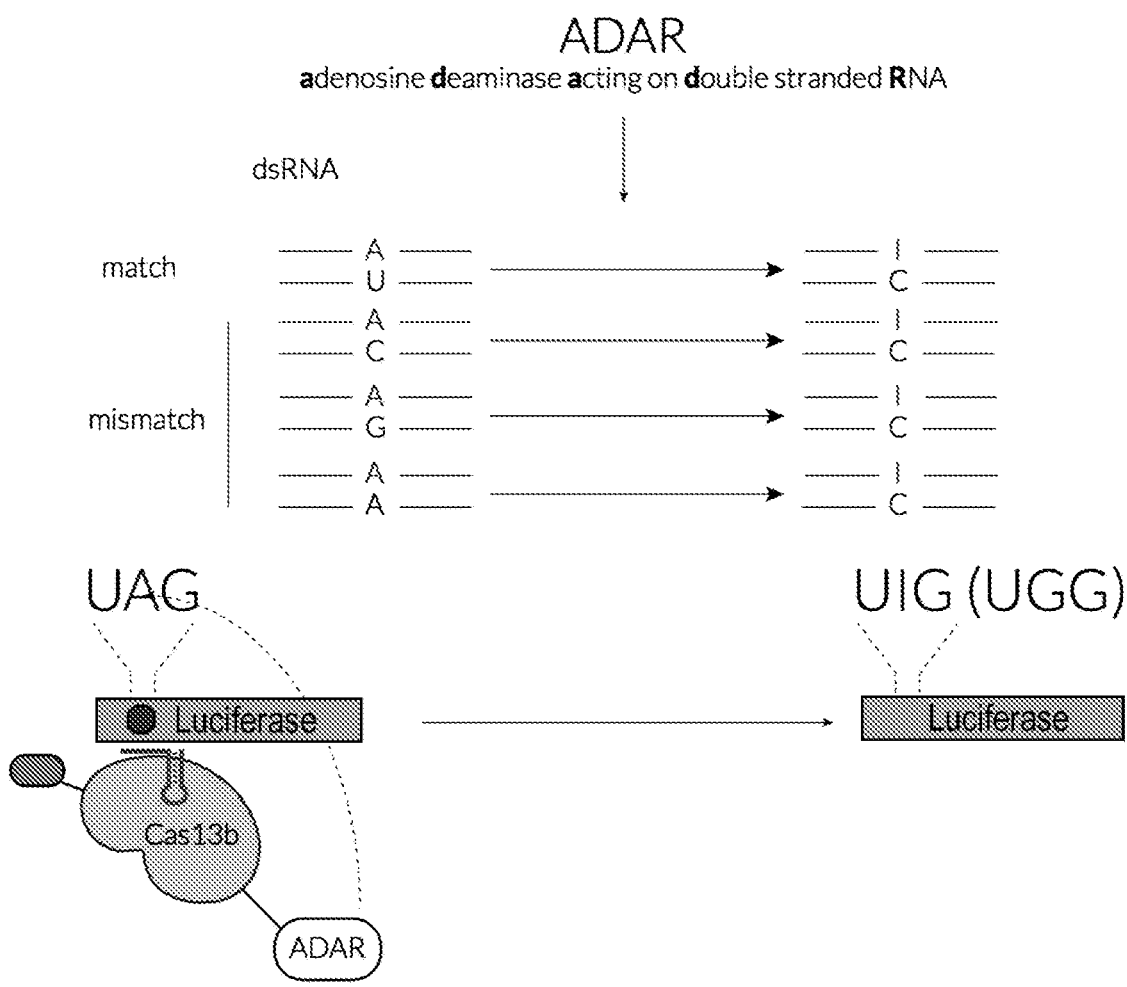
FIG. 15: Mismatch for on-target activity

To reduce off targets at adenosines near the target adenosine editing site, guides were designed that have G or A mismatches to the potential off-target adenosines (FIG. 14 and Table below). Mismatches with G or A are not favored for activity by the ADAR catalytic domain.

| Name | Guide |
|---|---|
| Luciferase guide WT with C mismatch (SEQ ID No. 162) | catagaatgttctaaaCCAtcctgeggcctctactctgcattcaa |
| Luciferase guide WT with C mismatch with 1 G MM (SEQ ID No. 163) | catagaatgttcGaaaCCAtcctgeggcctctactctgcattcaa |
| Luciferase guide WT with C mismatch with 2 G MM (SEQ ID No. 164) | catagaatgGtcGaaaCCAtcctgeggcctctactctgcattcaa |
| Luciferase guide WT with C mismatch with 1 G MM (SEQ ID No. 165) | catagaatgttcAaaaCCAtcctgeggcctctactctgcattcaa |
| Luciferase guide WT with C mismatch with 2 G MM (SEQ ID No. 166) | catagaatgAtcAaaaCCAtcctgeggcctctactctgcattcaa |
| KRAS guide WT with Cmismatch (SEQ ID No. 167) | ggtttctccatcaattacCacttgatcctgtaggaatcctctatt |
| KRAS guide with C mismatch with 1 G MM (SEQ ID No. 168) | ggtttctccatcaatGacCacttgatcctgtaggaatcctctatt |
| KRAS guide with C mismatch with 2 G MM (SEQ ID No. 169) | ggtttctccatcaaGGacCacttgatcctgtaggaatcctctatt |
| KRAS guide with C mismatch with 1 A MM (SEQ ID No. 170) | ggtttctccatcaatAacCacttgatcctgtaggaatcctctatt |
| KRAS guide with C mismatch with 2 A MM (SEQ ID No. 171) | ggtttctccatcaaAAacCacttgatcctgtaggaatcctctatt |
| PPIB guide WT with C mismatch (SEQ ID No. 172) | gcctttctctectgtagcCaaggccacaaaattatccactgttttt |

-continued

| Name | Guide |
|---|---|
| PPIB guide WT with C mismatch with 1 G MM (SEQ ID No. 173) | gcctttctctectgGagcCaaggccacaaaattat ccactgttttt |
| PPIB guide WT with C mismatch with 1 A MM (SEQ ID No. 174) | gcctttctctectgAagcCaaggccacaaaattat ccactgttttt |

The guides in the Table above were designed to have a C mismatch against the on-target adenosine to be edited and G or A mismatches against known off-target sites (based off of the RNA sequencing from above). Mismatches in the spacer sequence are capitalized.

Mismatch for On-Target Activity

Figure 16:
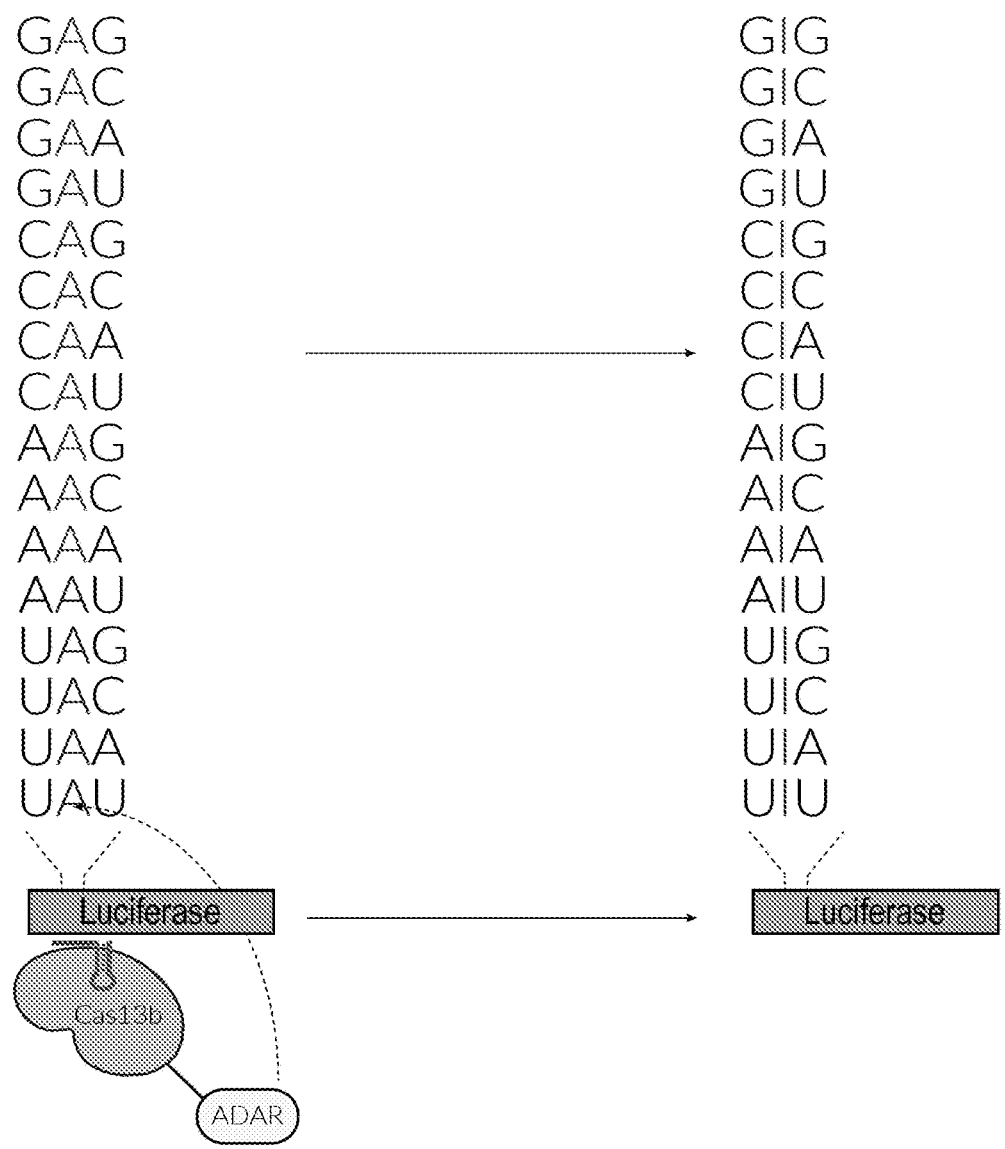
FIG. 16: ADAR Motif preference

Prior research on the catalytic domain of ADAR2 has demonstrated that different bases opposite the target A can influence the amount of inosine editing (Zheng et al. (2017), Nucleic Acid Research, 45(6):3369-3377). Specifically, U and C are found opposite natural ADAR-edited A's, whereas G and A are not. To test whether or not A and G mismatches with the edited A can be used to suppress ADAR activity a guide known to be active with a C mismatch is tested with all other 3 possible bases on the luciferase reporter assay (FIG. 16). Relative activities are quantified by assessing luciferase activity. Guide sequences are provided in the Table below.

| Mismatch | Guide sequence |
|---|---|
| Mismatch-C (SEQ ID No. 175) | GcatagaatgttctaaaCCAtcctgegg cctctactctgcattcaa |
| Mismatch-G (SEQ ID No. 176) | GcatagaatgttctaaaCGAtcctgegg cctctactctgcattcaa |
| Mismatch-T (SEQ ID No. 177) | GcatagaatgttctaaaCTAtcctgegg cctctactctgcattcaa |
| Mismatch-A (SEQ ID No. 178) | GcatagaatgttctaaaCAAtcctgegg cctctactctgcattcaa |

Improvement of Editing and Reduction of Off-Target Modification by Chemical Modification of gRNAs gRNAs which are chemically modified as exemplified in Vogel et al. (2014), Angew Chem Int Ed, 53:6267-6271, doi:10.1002/anie.201402634) to reduce off-target activity and to improve on-target efficiency. 2'-O-methyl and phosphorothioate modified guide RNAs in general improve editing efficiency in cells.

Motif Preference

Figure 17:
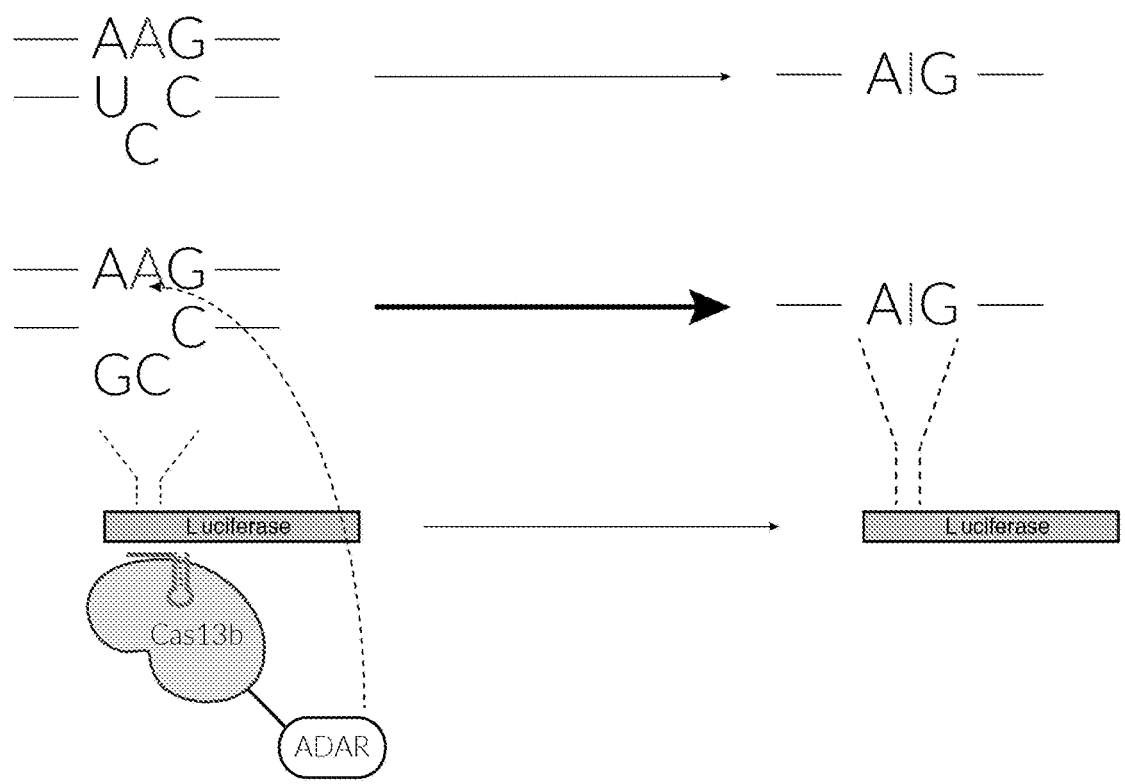
FIG. 17: Larger bubbles to enhance RNA editing efficiency

ADAR has been known to demonstrate a preference for neighboring nucleotides on either side of the edited A (www.nature.com/nsmb/journal/v23/n5/full/nsmb.3203.html, Matthews et al. (2017), Nature Structural Mol Biol, 23(5): 426-433). The preference is systematically tested by targeting Cypridina luciferase transcripts with variable bases surrounding the targeted A (FIG. 17).

Larger Bubbles to Enhance RNA Editing Efficiency

Figure 18:
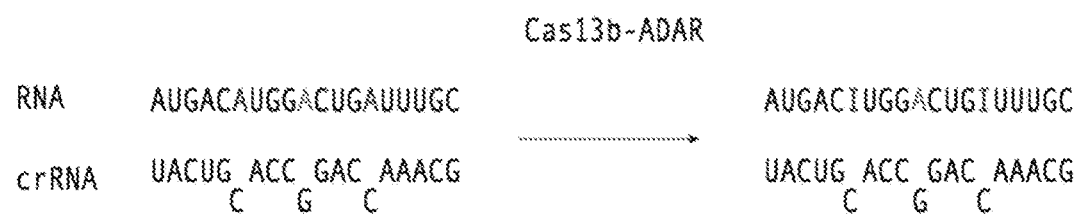
FIG. 18: Editing of multiple A's in a transcript (SEQ ID Nos. 669-672)

To enhance RNA editing efficiency on non-preferred 5' or 3' neighboring bases, intentional mismatches in neighboring bases are introduced, which has been demonstrated in vitro to allow for editing of non-preferred motifs (academic.oup-.com/nar/article-lookup/doi/10.1093/nar/gku272; Schneider et al (2014), Nucleic Acid Res, 42(10):e87); Fukuda et al. (2017), Scientific Reports, 7, doi:10.1038/srep41478). Additional mismatches are tested, such as guanosine substitutions, to see if they reduce natural preferences (FIG. 18).

Editing of Multiple A's in a Transcript

Figure 19:
FIG. 19: Guide length titration for RNA editing
Figure 20A:
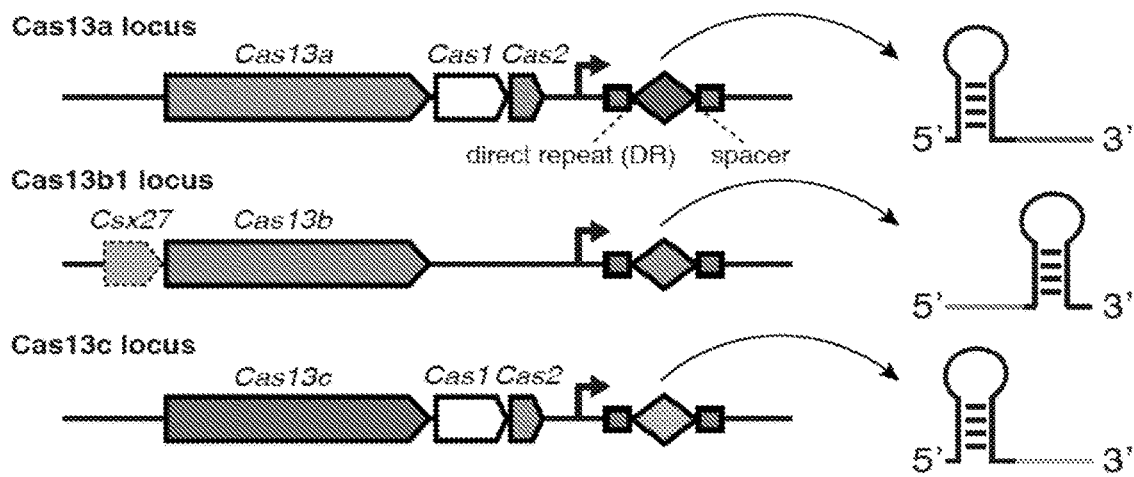
FIGS. 20A-20F: Mammalian codon-optimized Cas13b orthologs mediate highly efficient RNA knockdown.
Figure 20B:
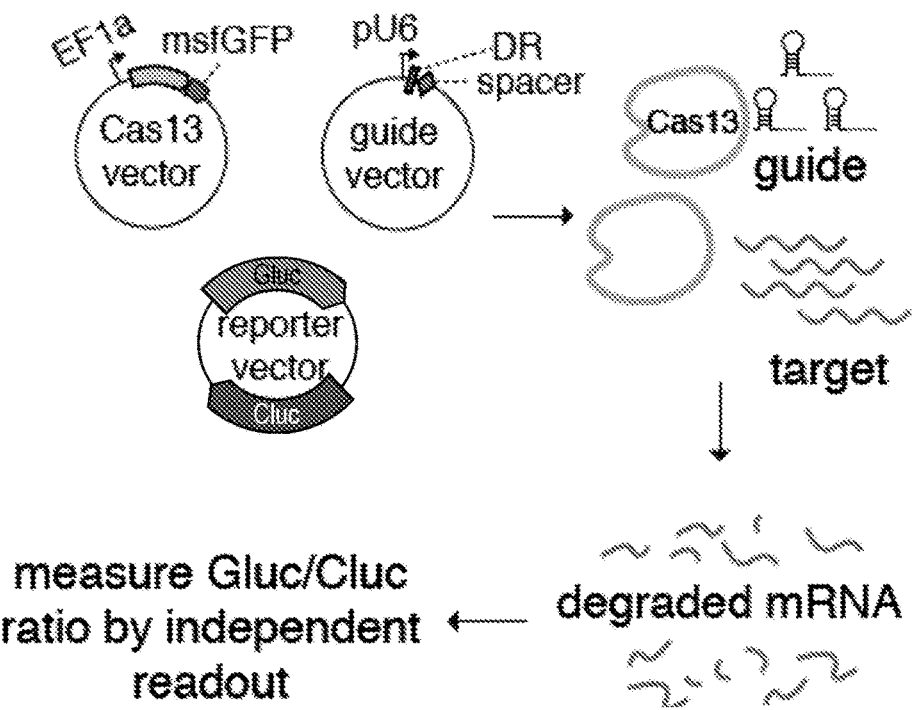
Figure 20C:
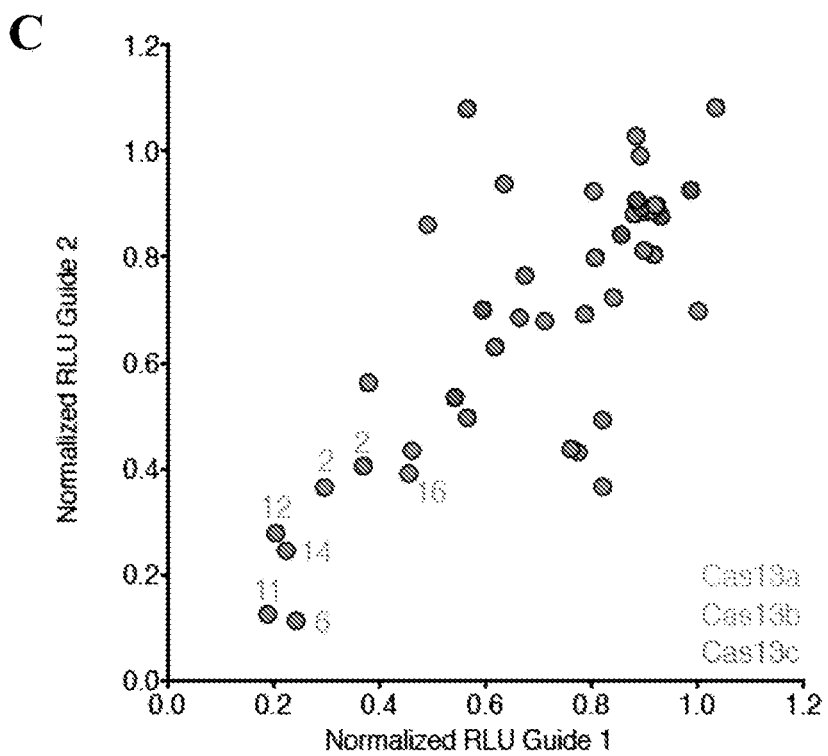
Figure 20D:
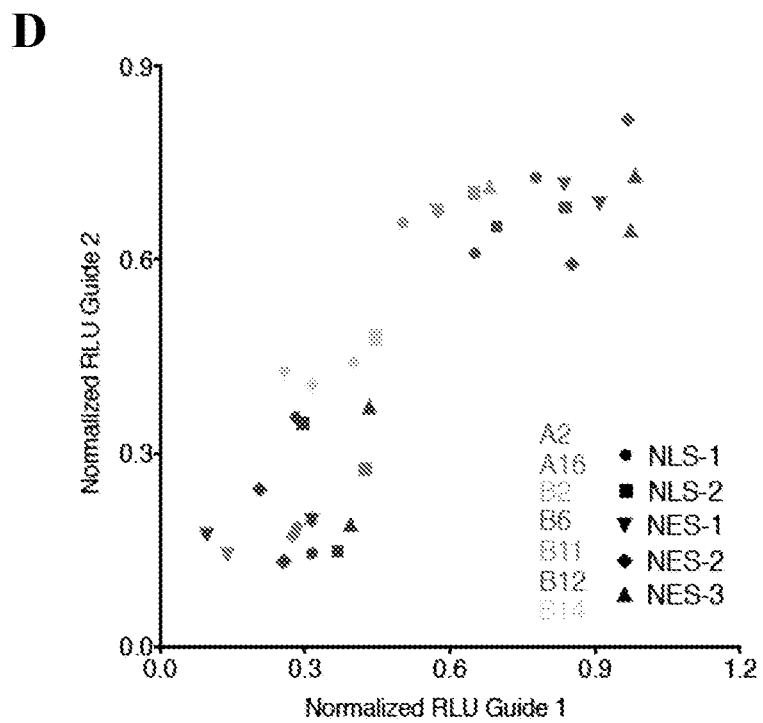
Figure 20E:
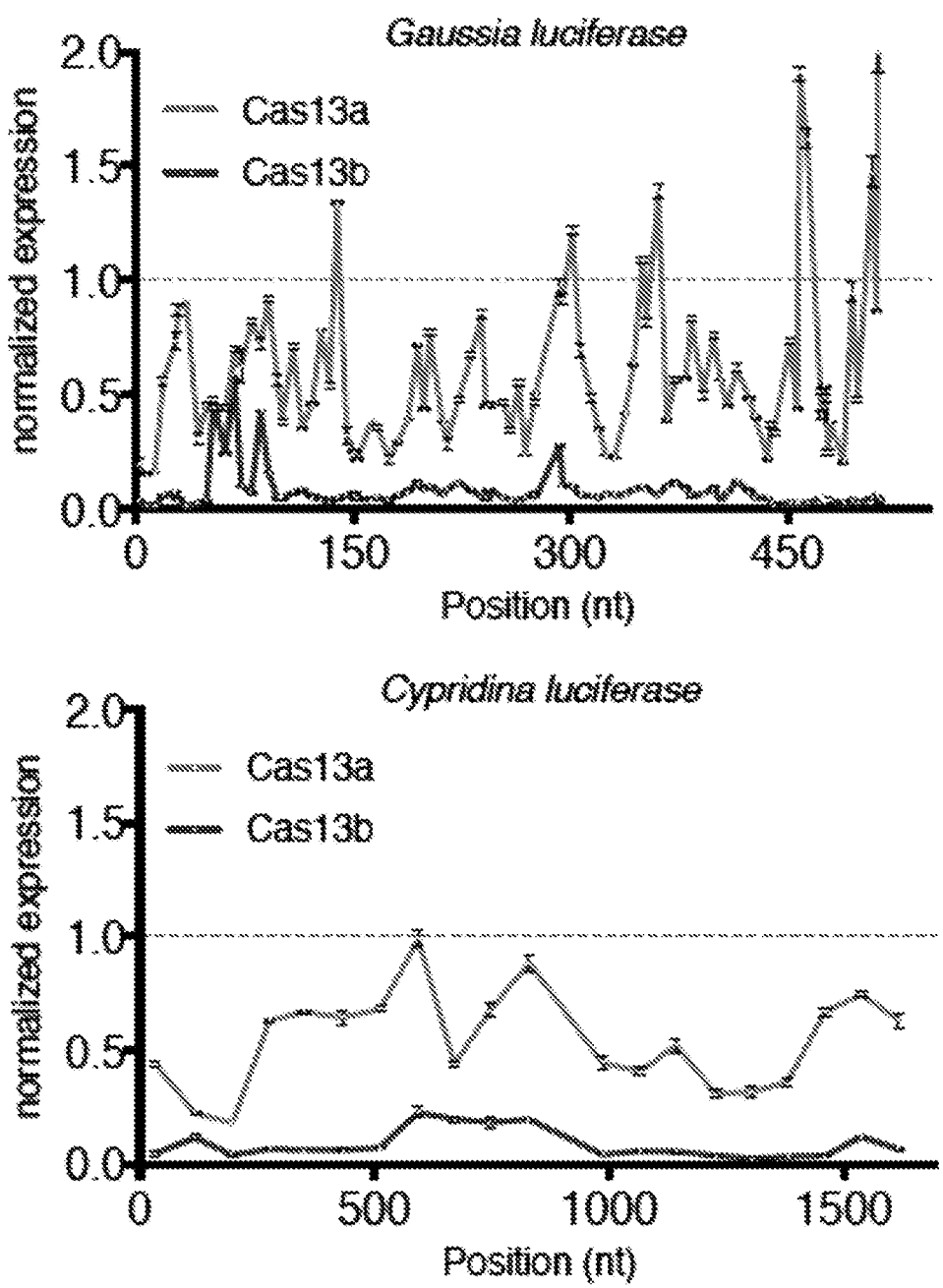
Figure 20F:
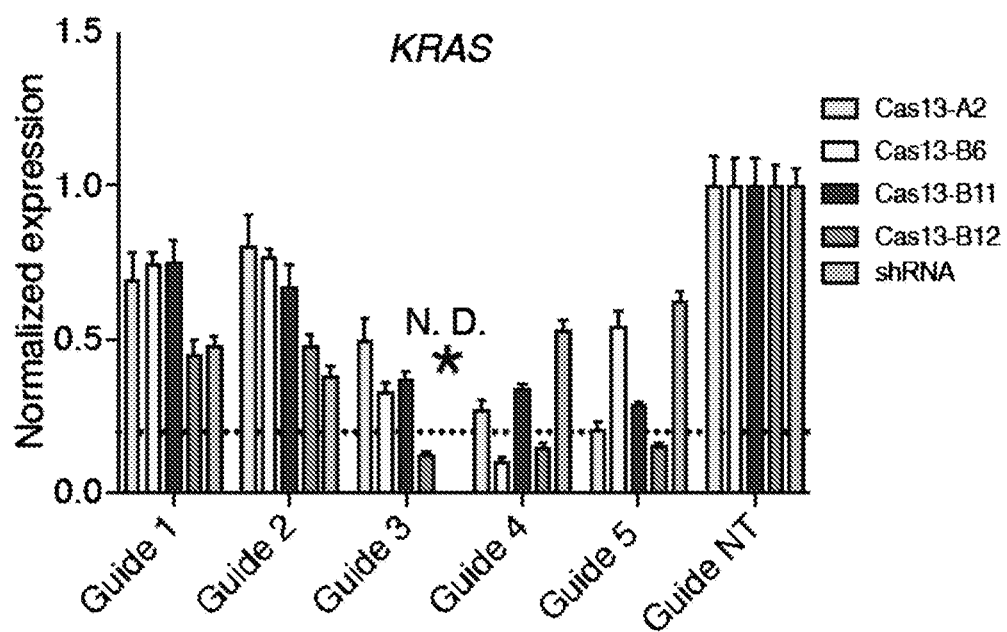
Figure 21B:
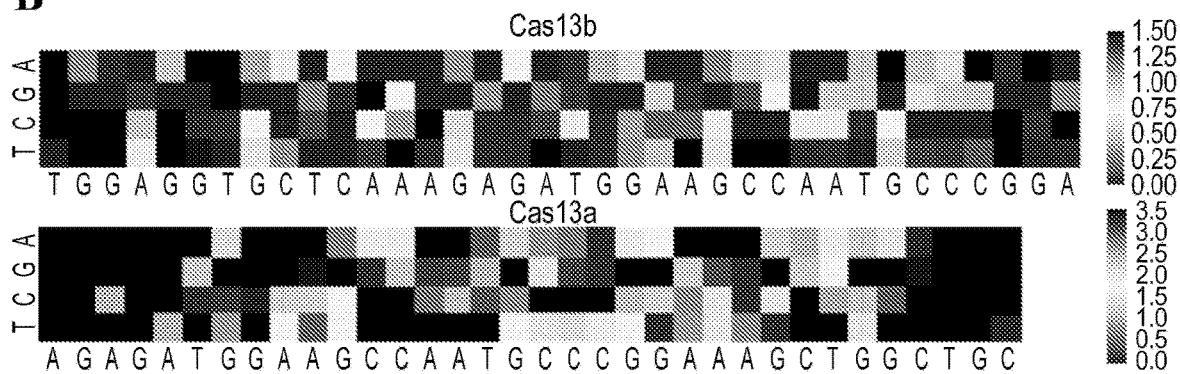
Figure 21C:
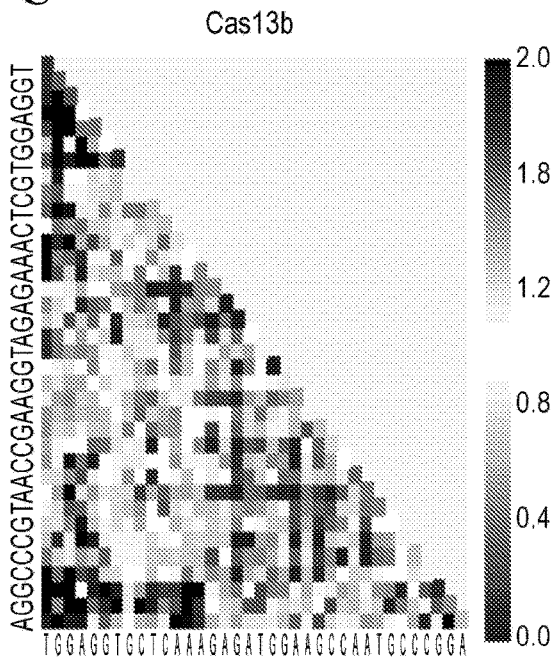
Figure 21D:
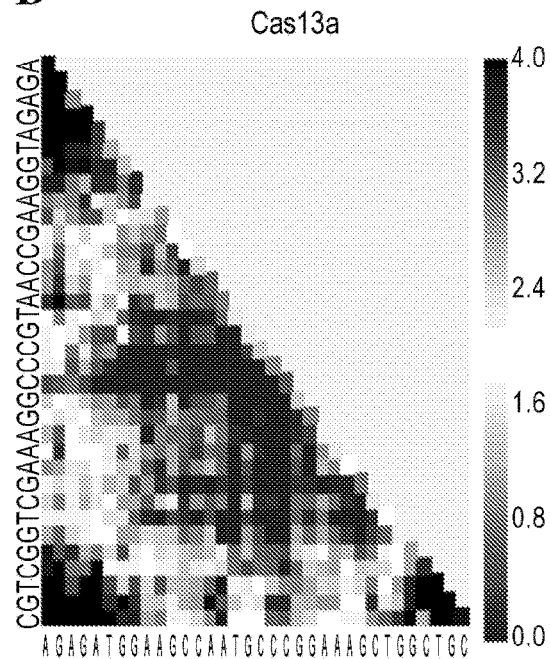
Figure 21E:
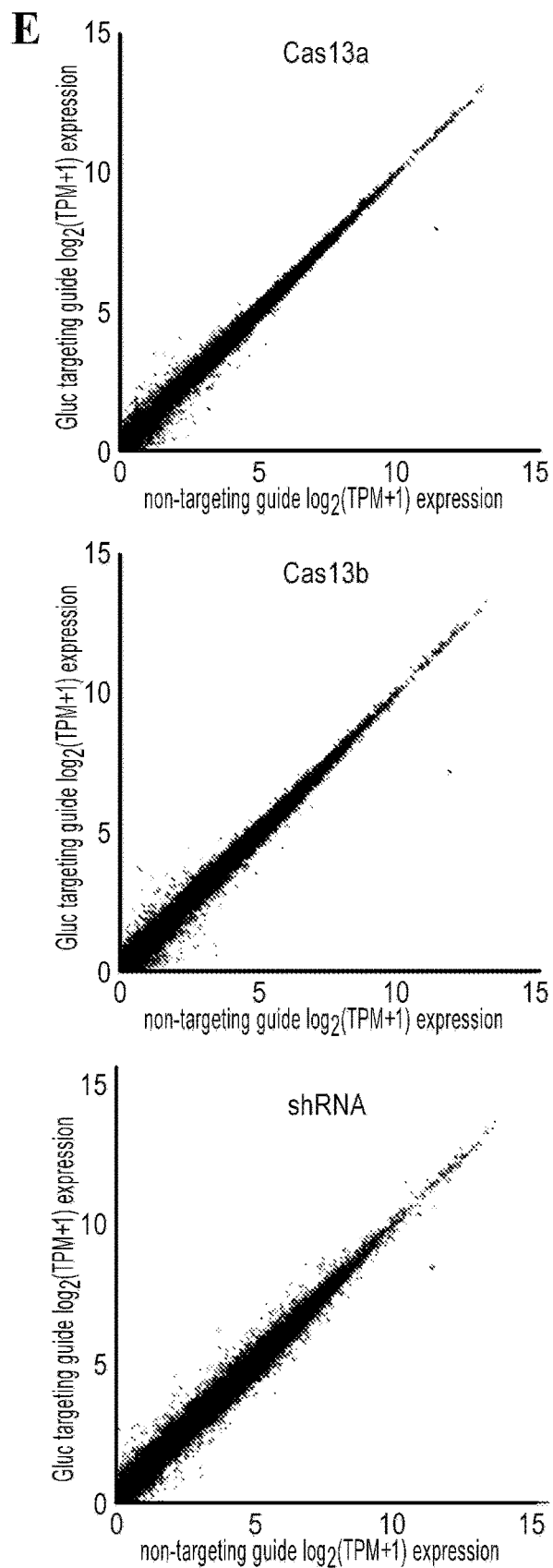
Figure 21F:
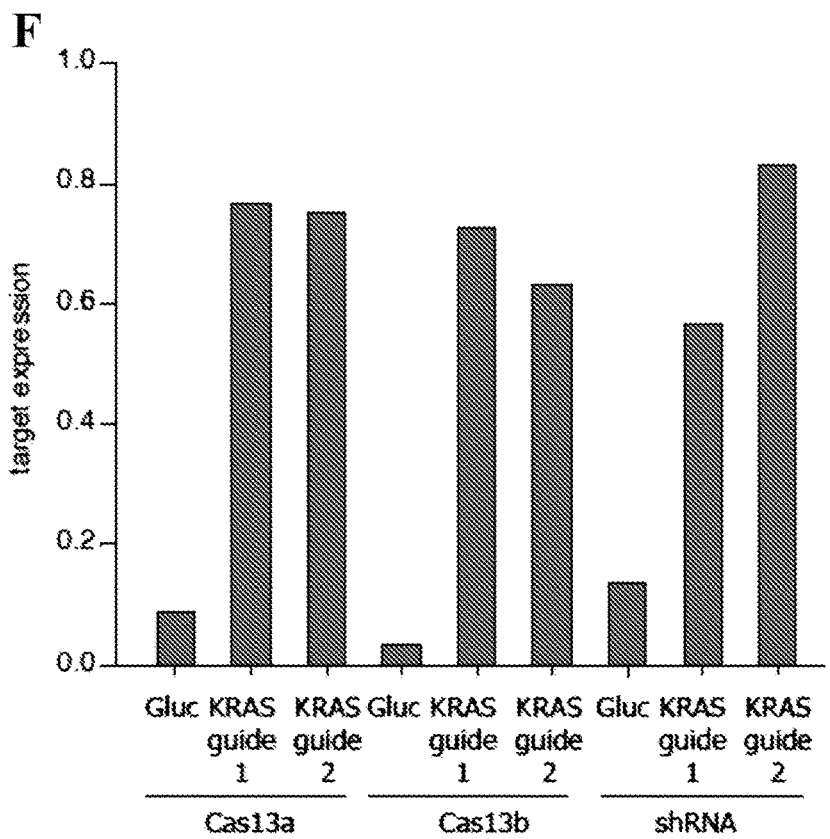
Figure 21G:
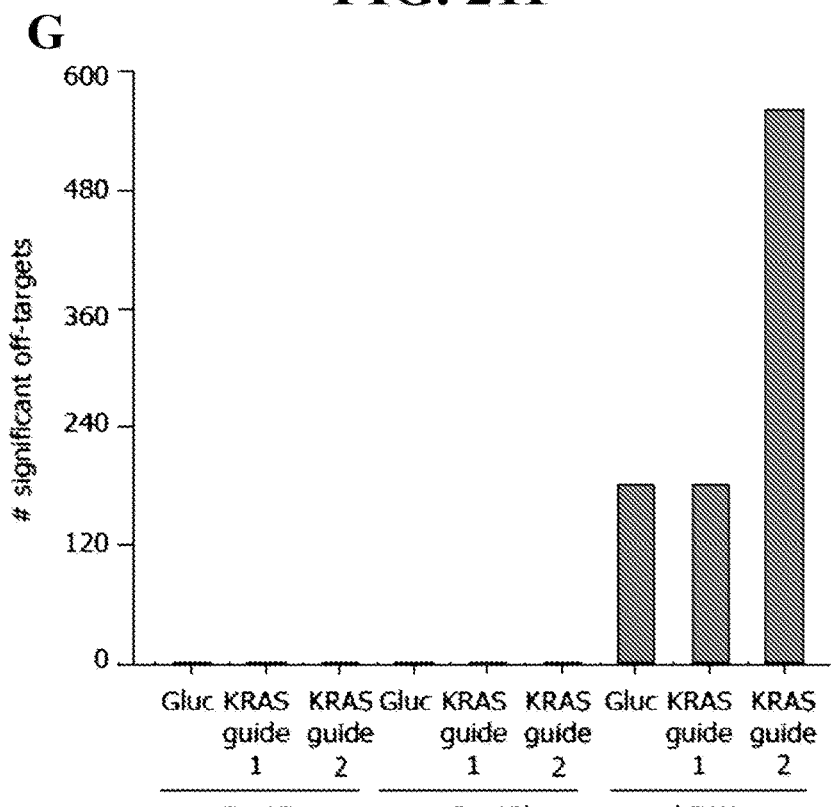
Figure 22A:
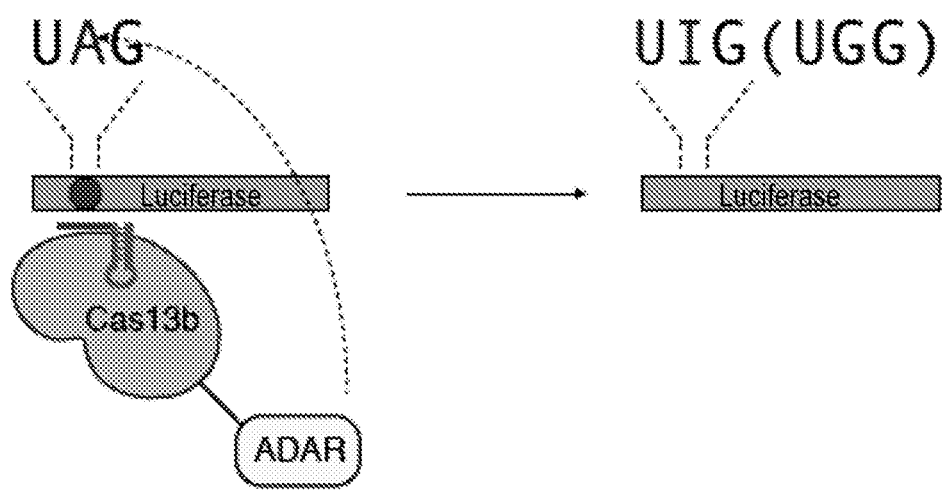
FIGS. 22A-22F: Catalytically inactive Cas13b-ADAR fusions enable targeted RNA editing in mammalian cells.
Figure 22B:
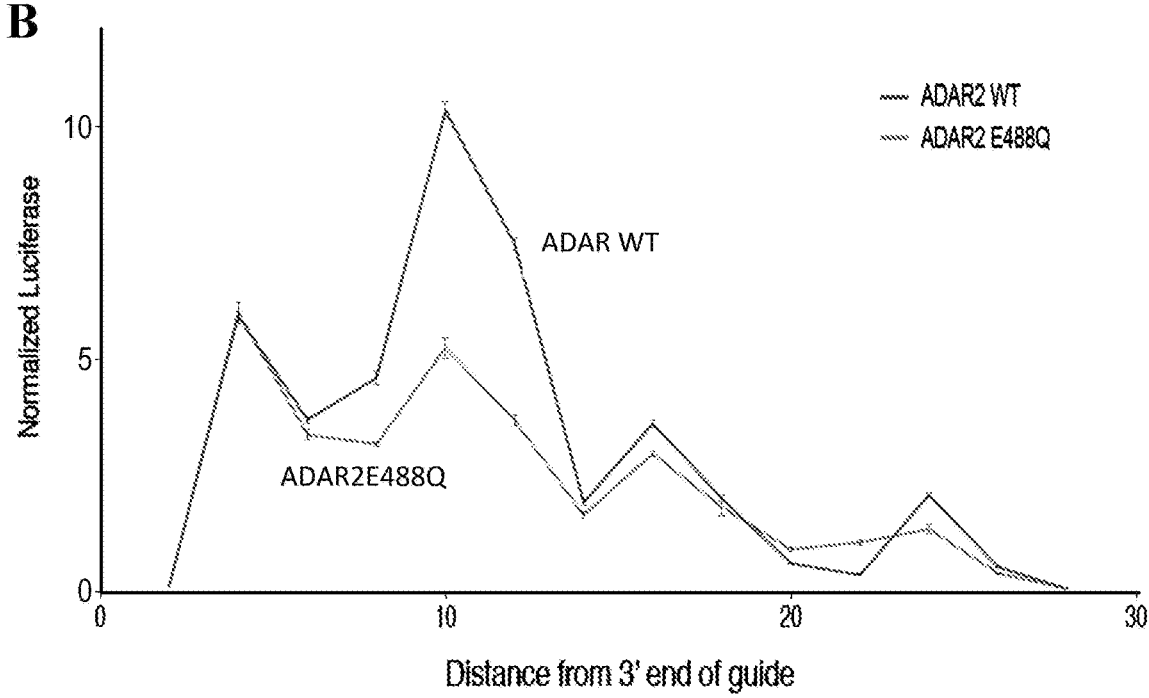
Figure 22C:
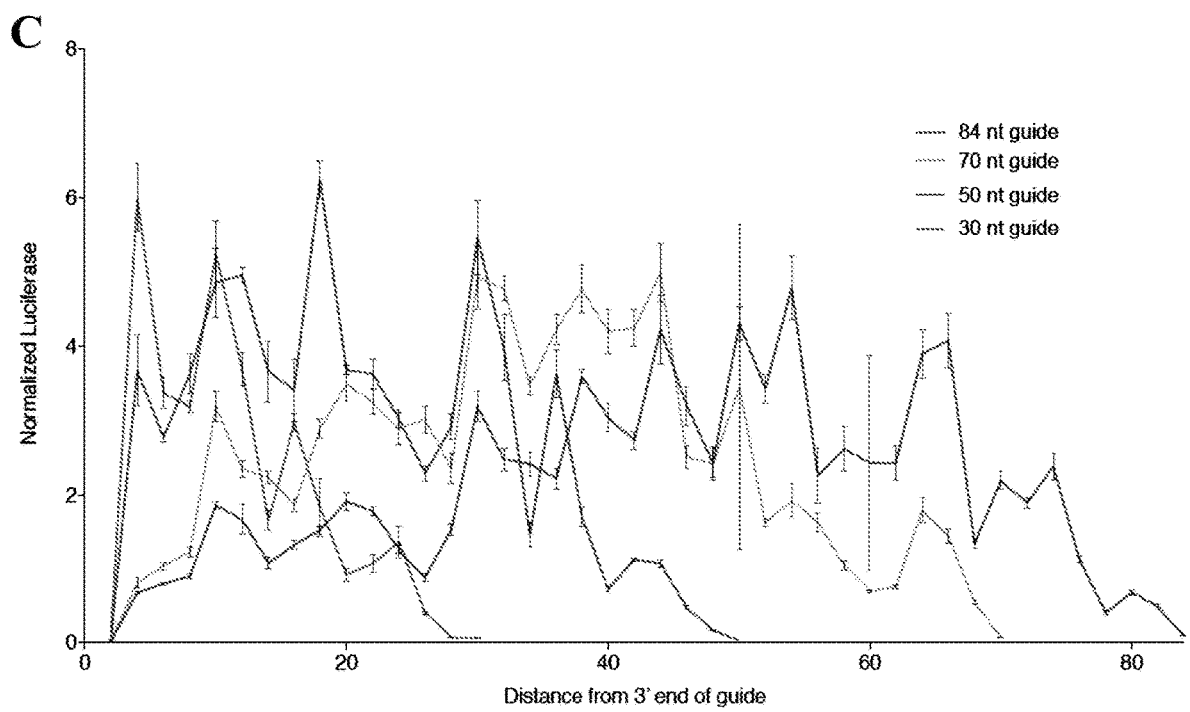
Figure 22D:
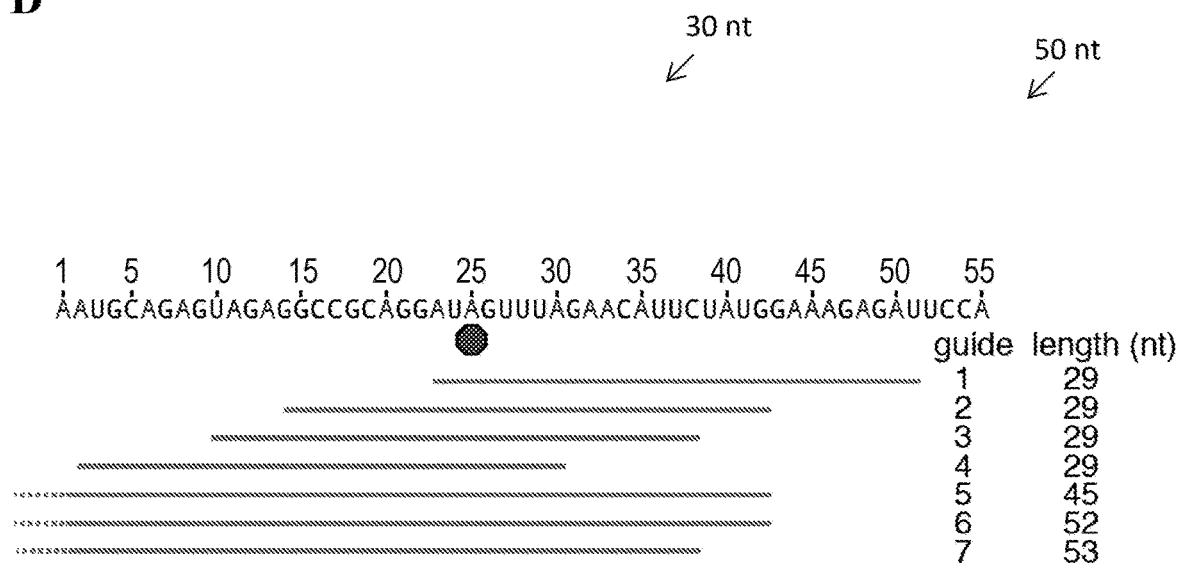
Figure 22E:
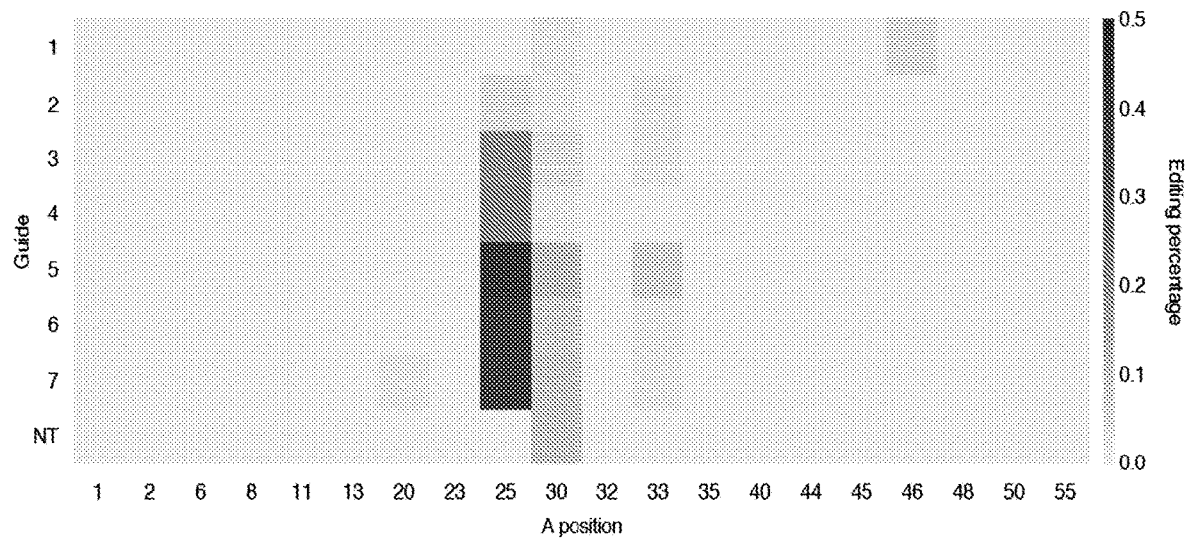
Figure 22F:
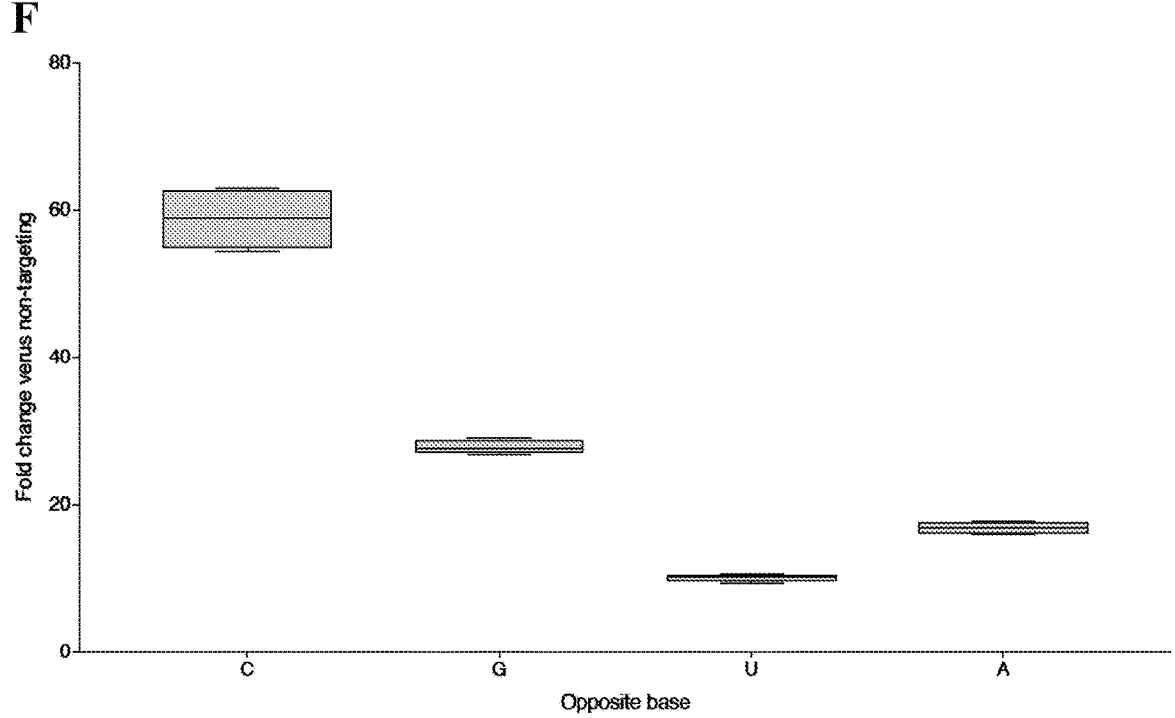
Figure 23:
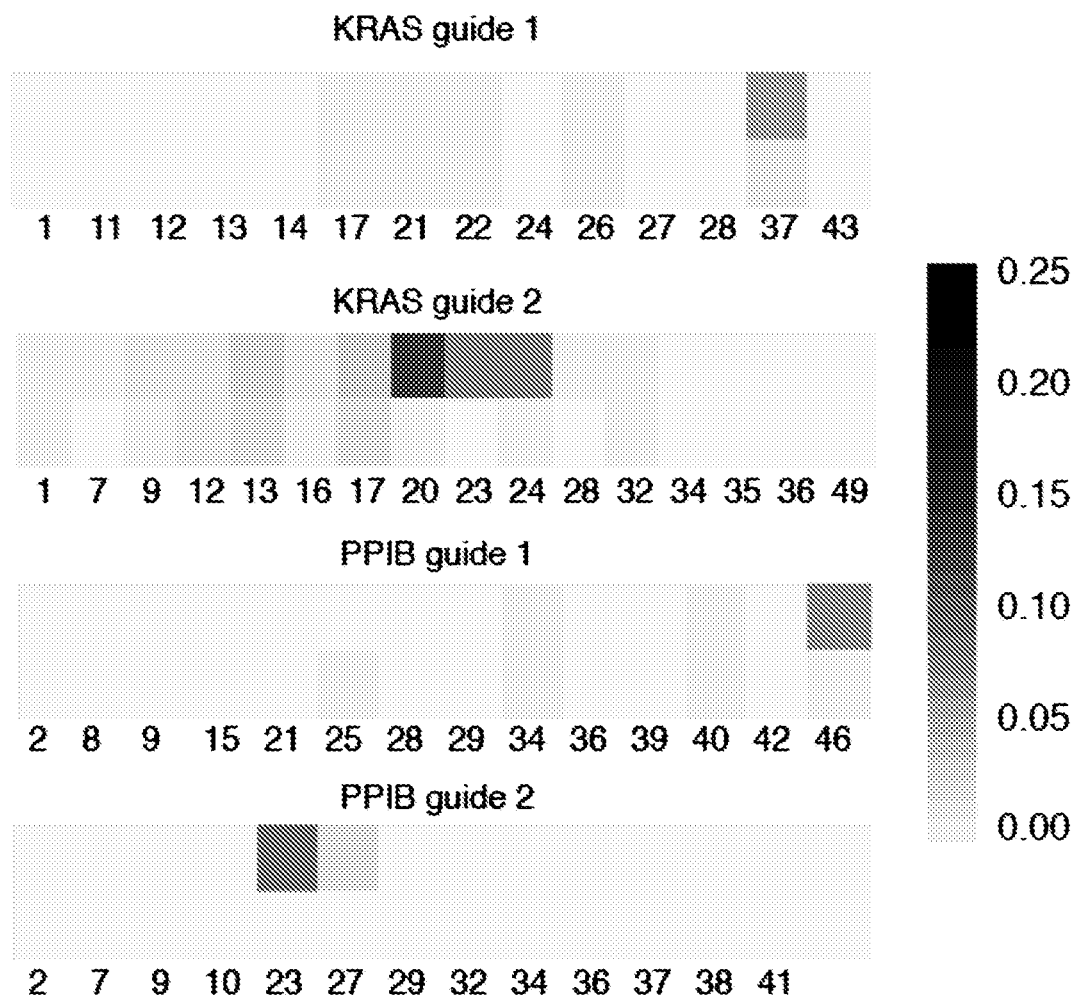
FIG. 23: Endogenous RNA editing with Cas13b-ADAR fusions. Next generation sequencing of endogenous Cas13b12-ADAR editing of endogenous KRAS and PPIB loci. Two different regions per transcript were targeted and A→G editing was quantified at all adenines in the vicinity of the targeted adenine. A pre-termination site in the STK11 transcript in A549 cells is targeted with Cas13b12-ADAR, restoring expression of the STK11 protein.
Figure 24:
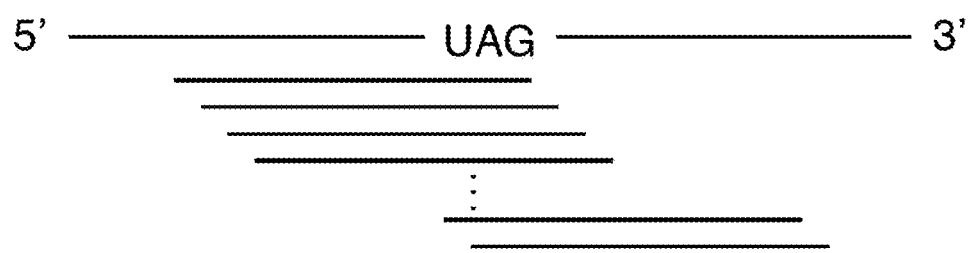
FIG. 24: Strategy for determining optimal guide position.
Figure 25A:
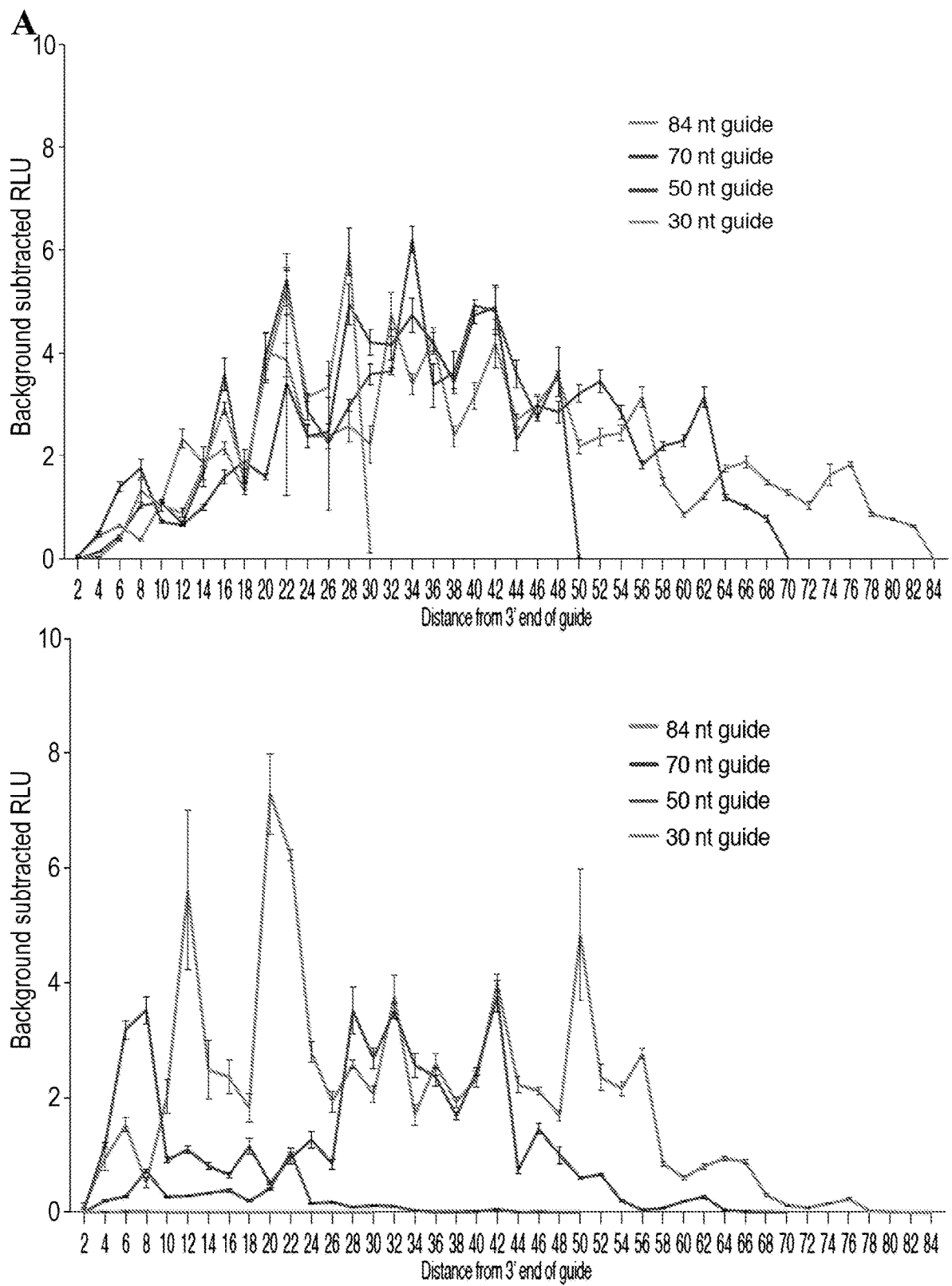
FIGS. 25A-25C.
Figure 25B:
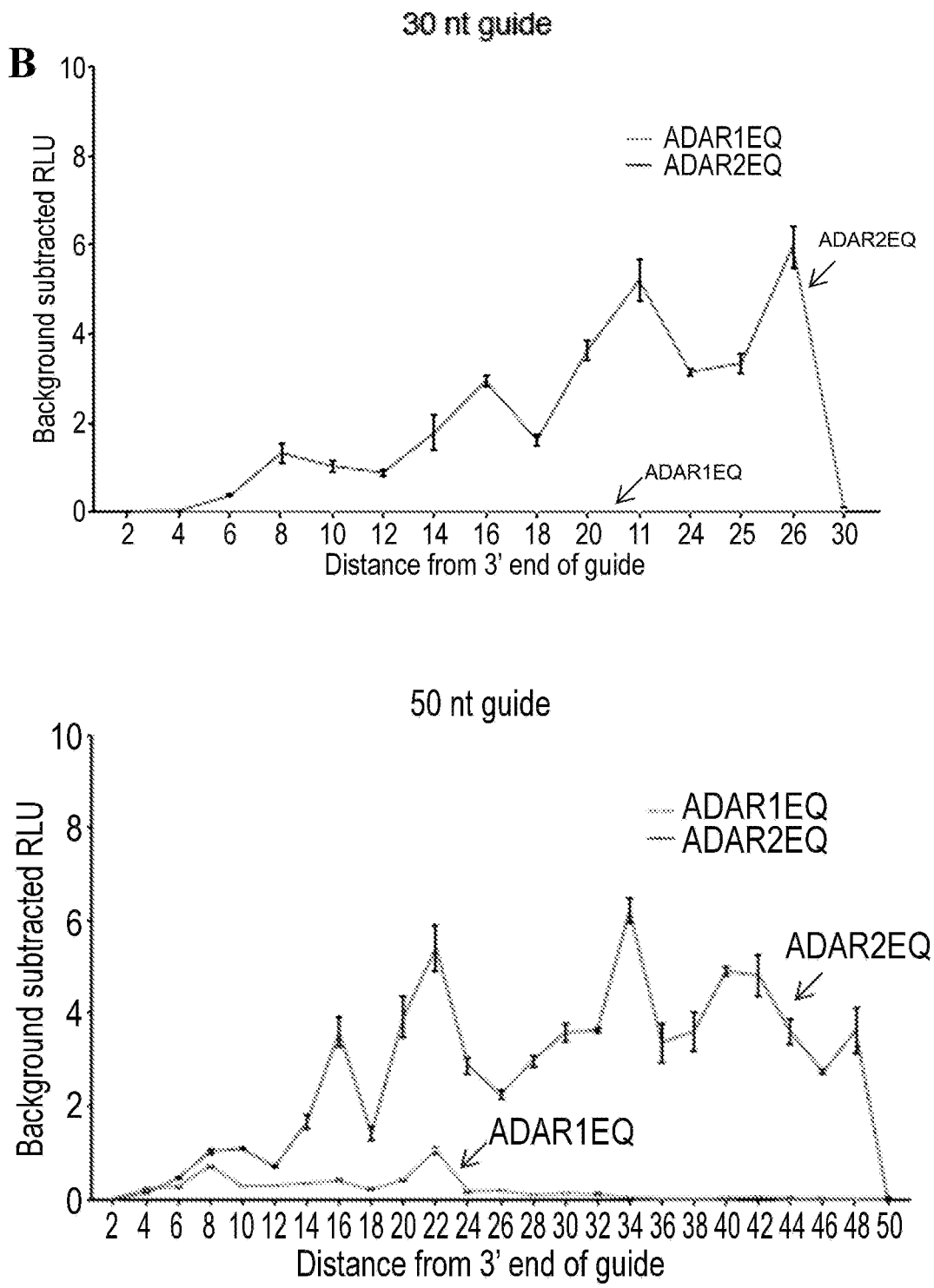
Figure 25C:
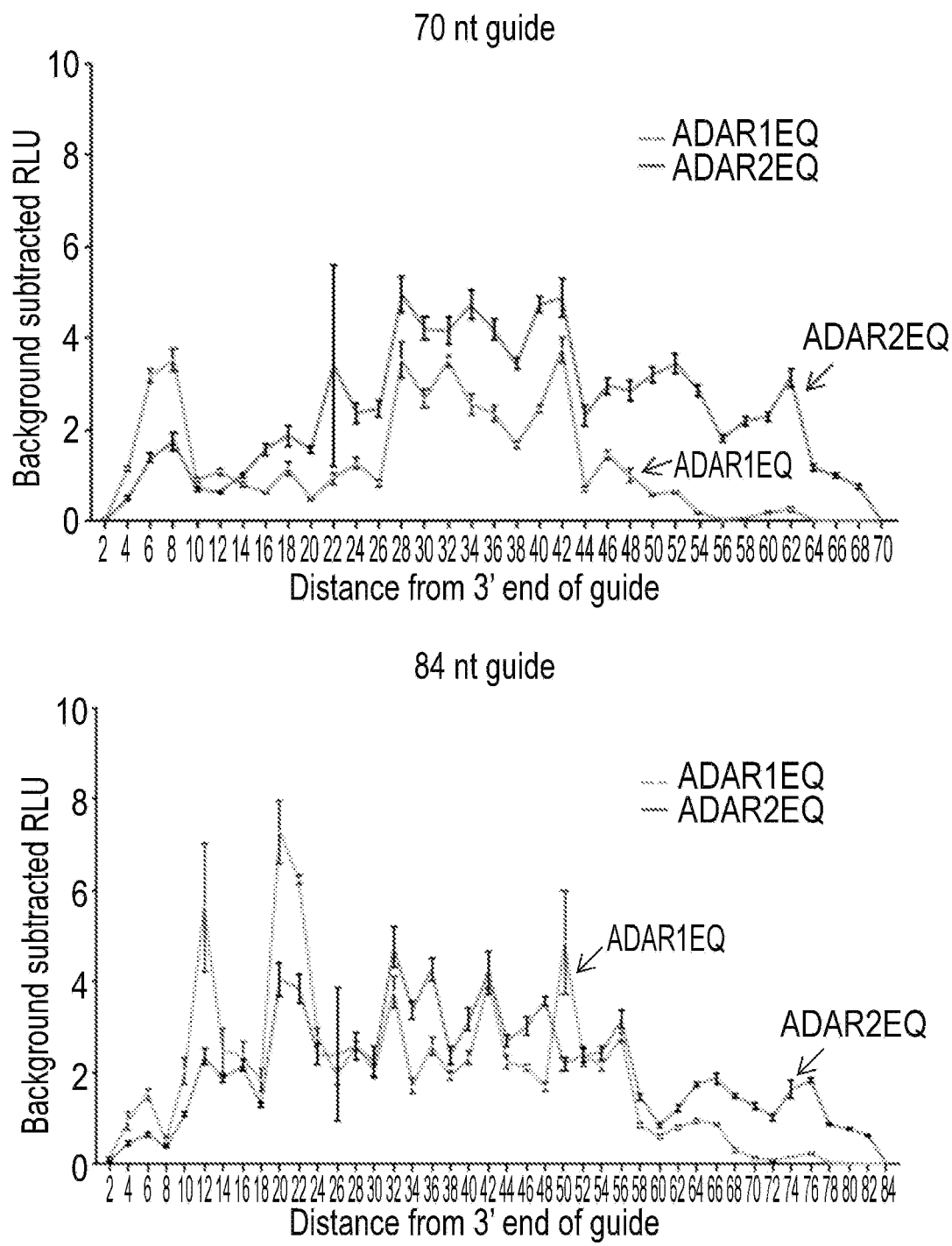
Figure 26:
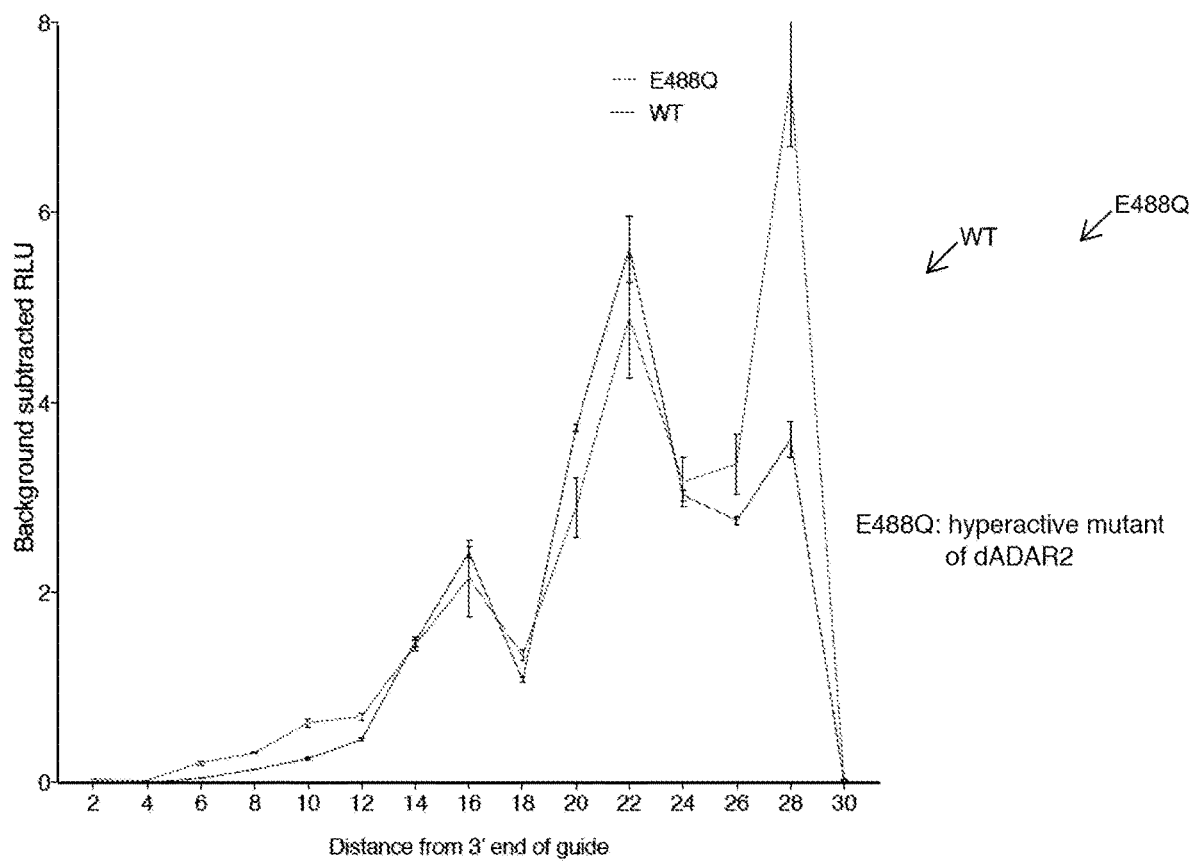
FIG. 26: Comparison of E488Q vs. wt dADAR2 editing. E488Q is a hyperactive mutant of dADAR2.
Figure 27A:
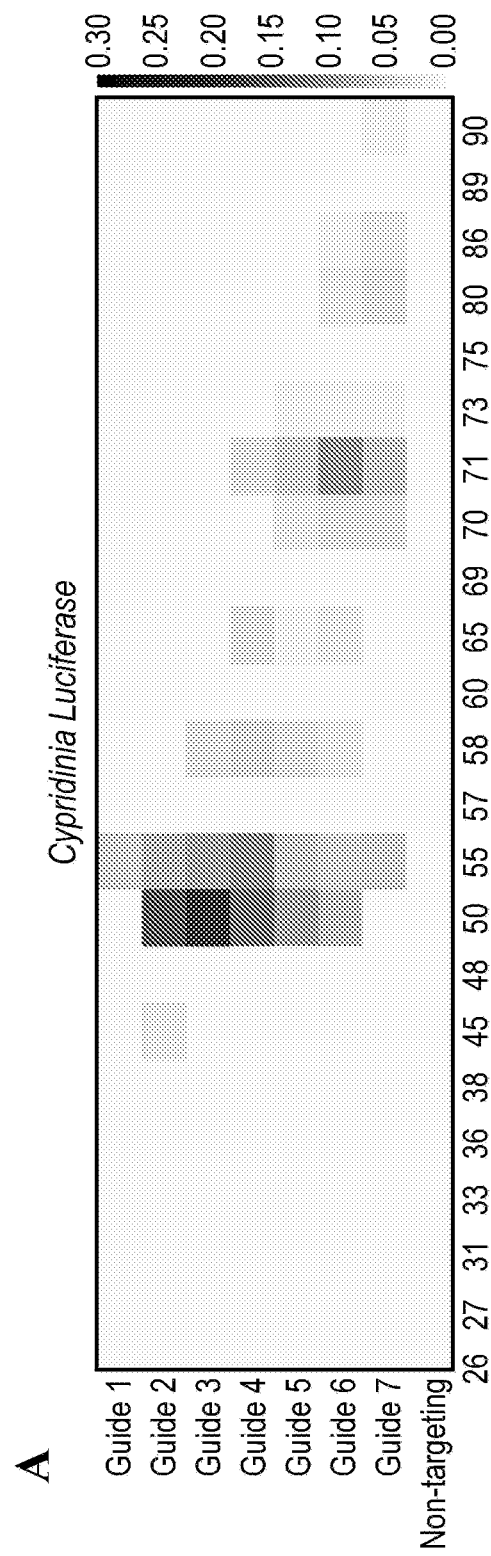
Figure 28A:
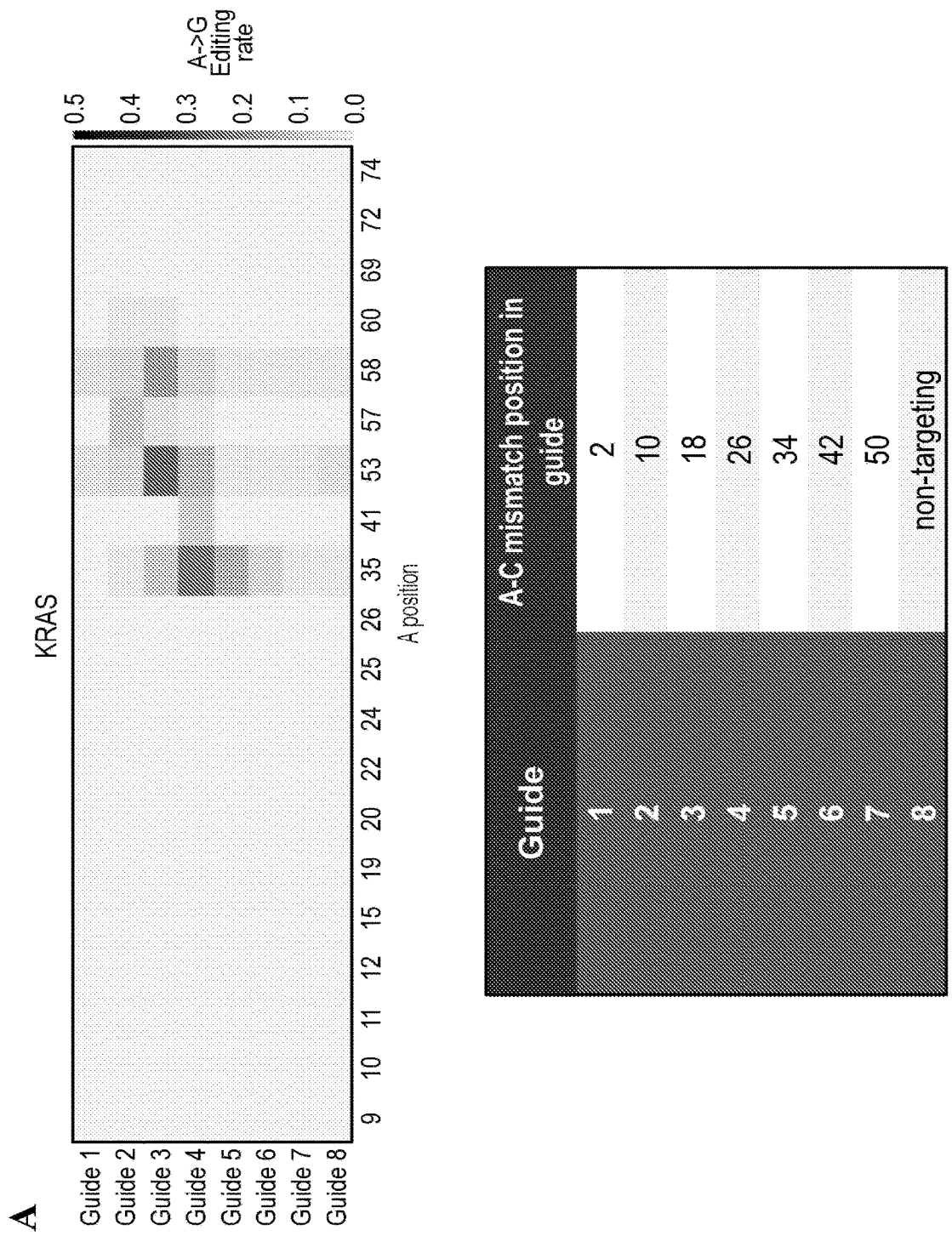
FIGS. 28A-28B: Endogenous tiling of guides.
Figure 28B:
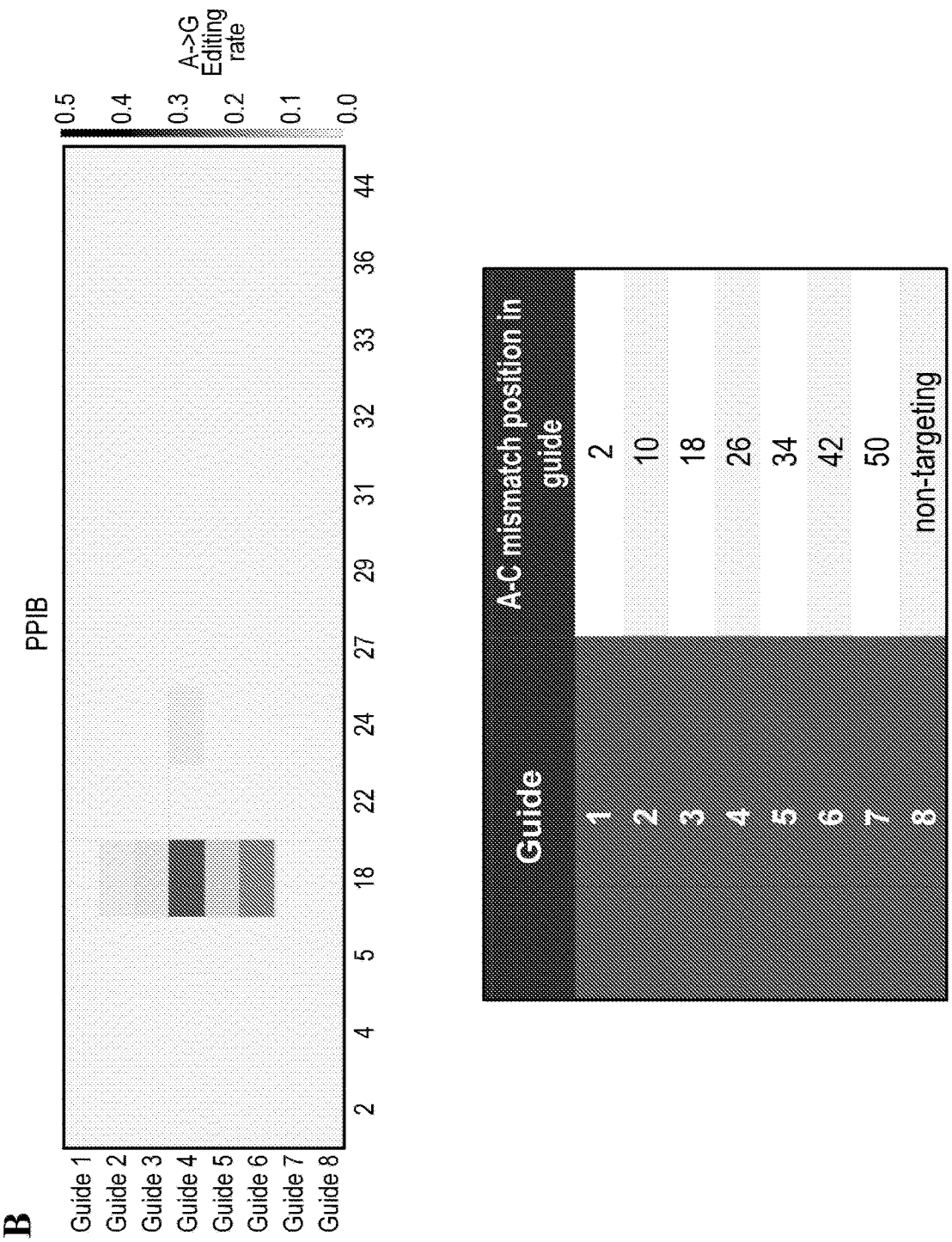
Figure 29:
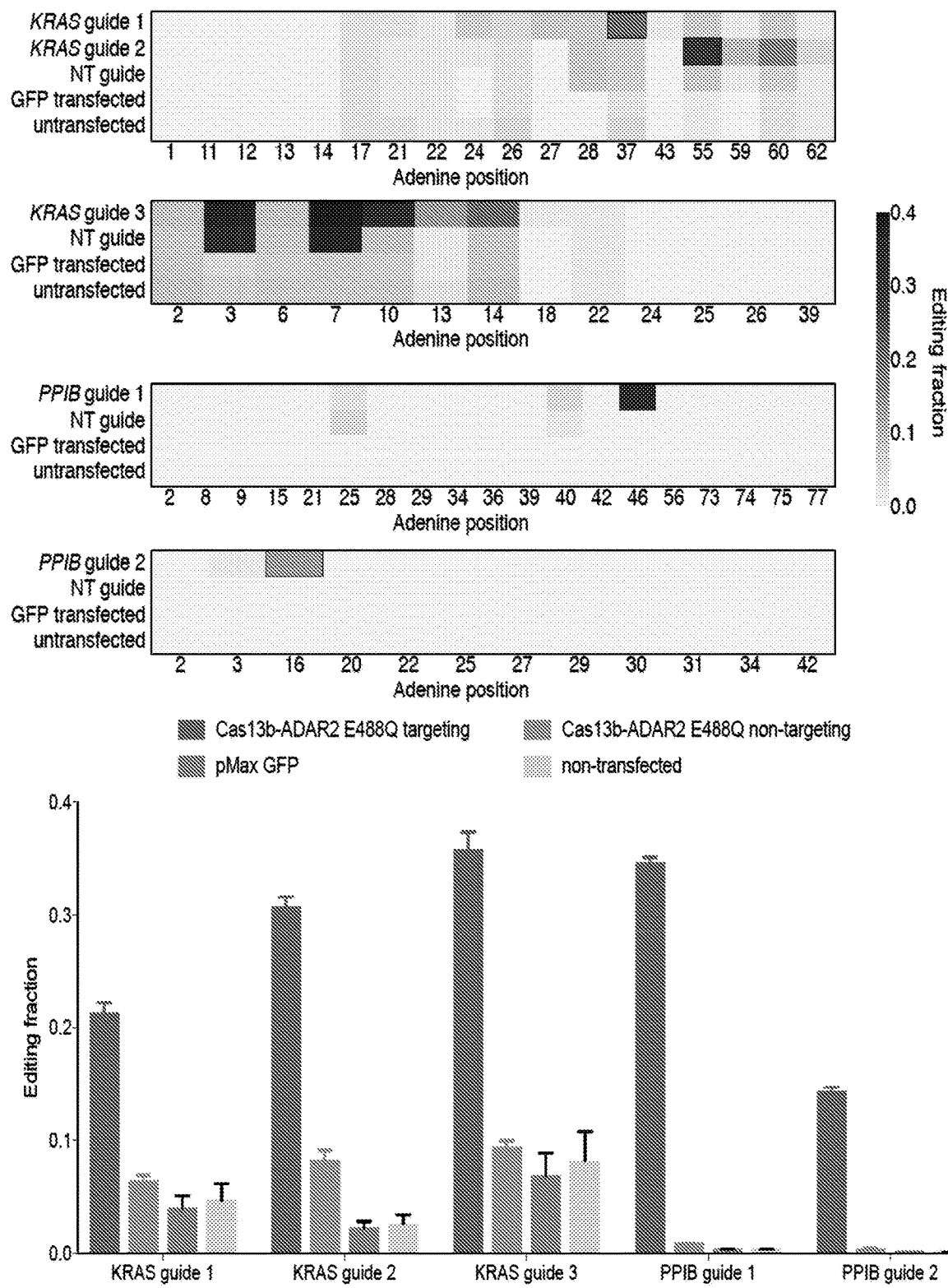
FIG. 29: Non-targeting editing.
Figure 30:
FIG. 30: Linker optimization.
Figure 31:
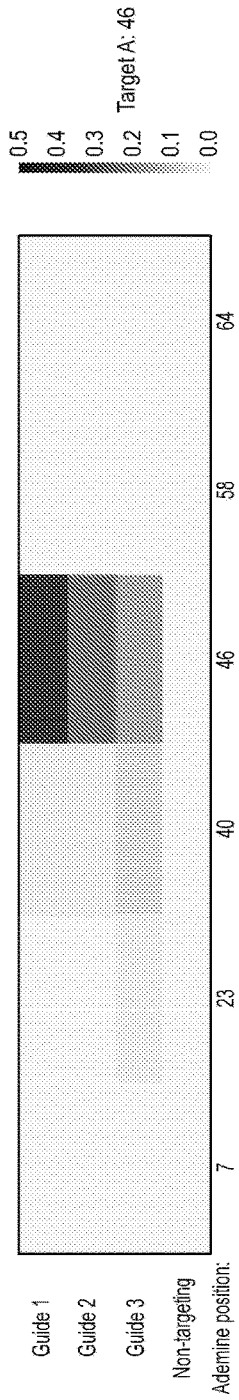
FIG. 31: Cas13b ADAR can be used to correct pathogenic A>G mutations from patients in expressed cDNAs.
Figure 32:
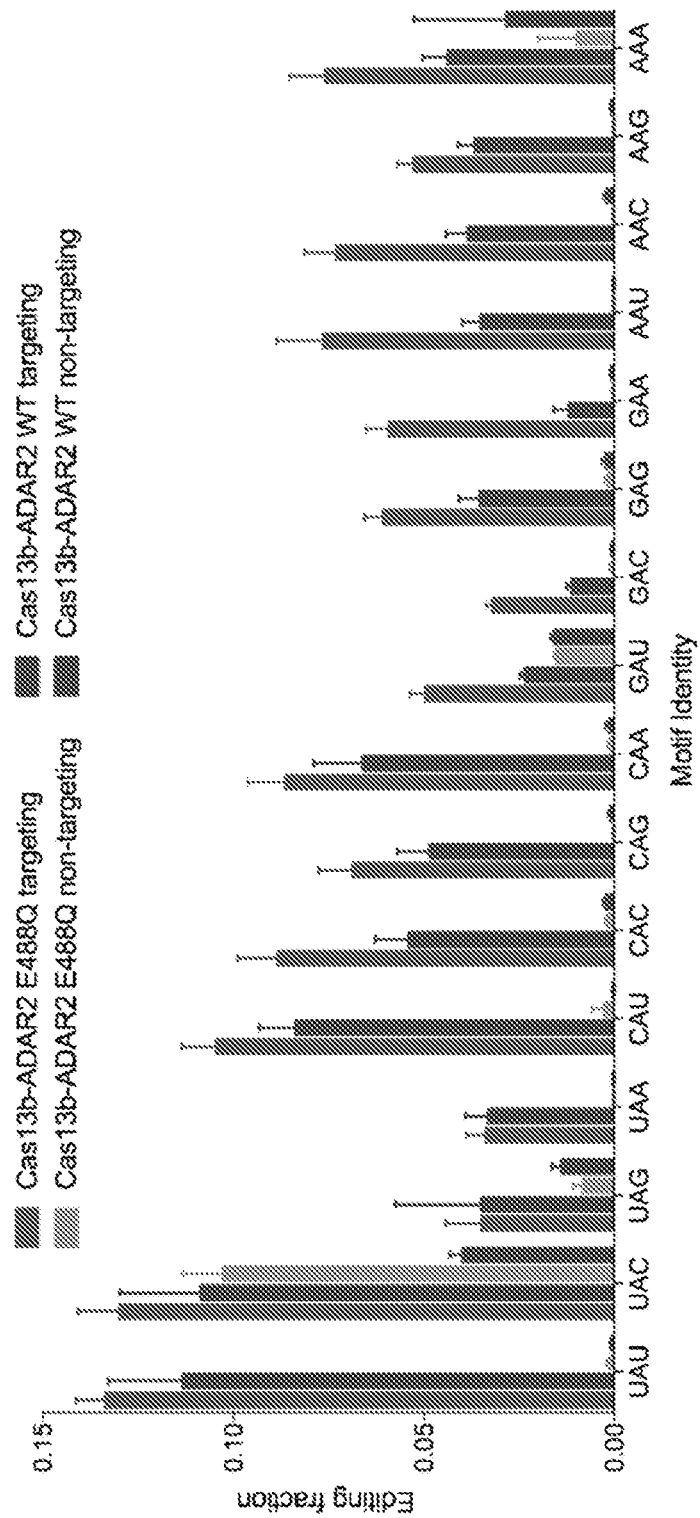
FIG. 32: Cas13b-ADAR has a slight restriction on 5' G motifs.
Figure 33C:
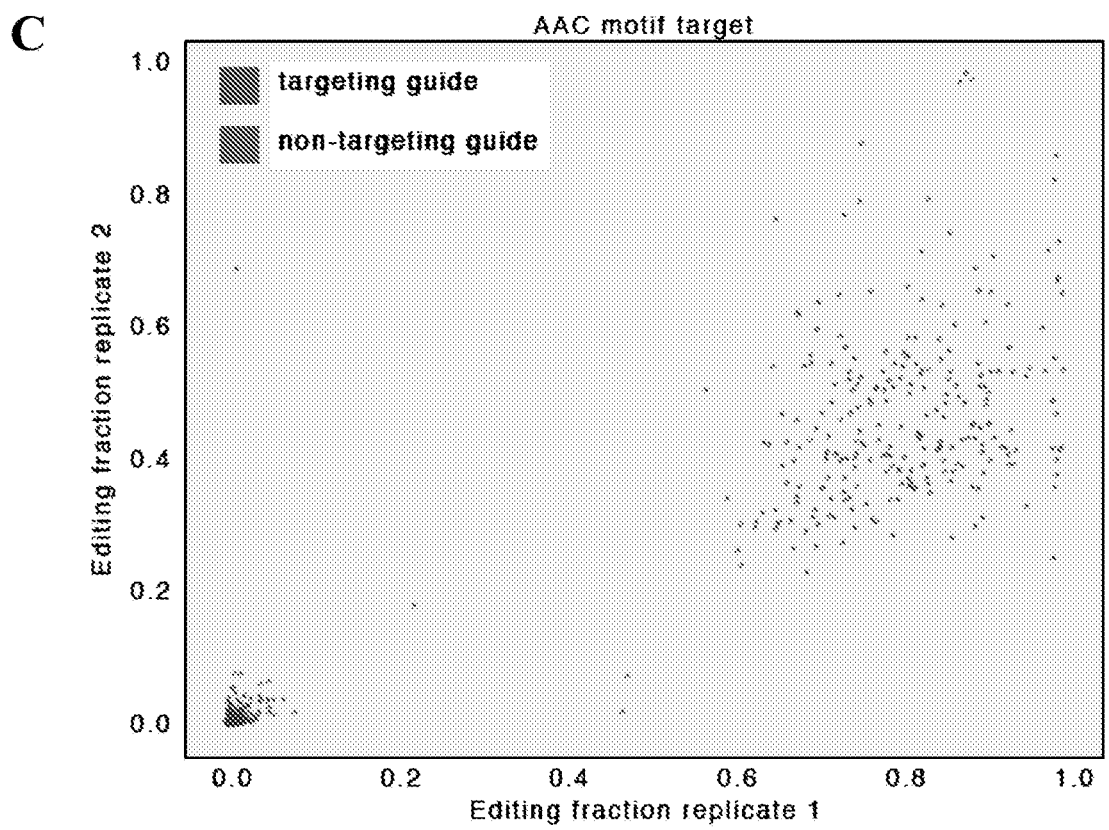
Figure 33D:
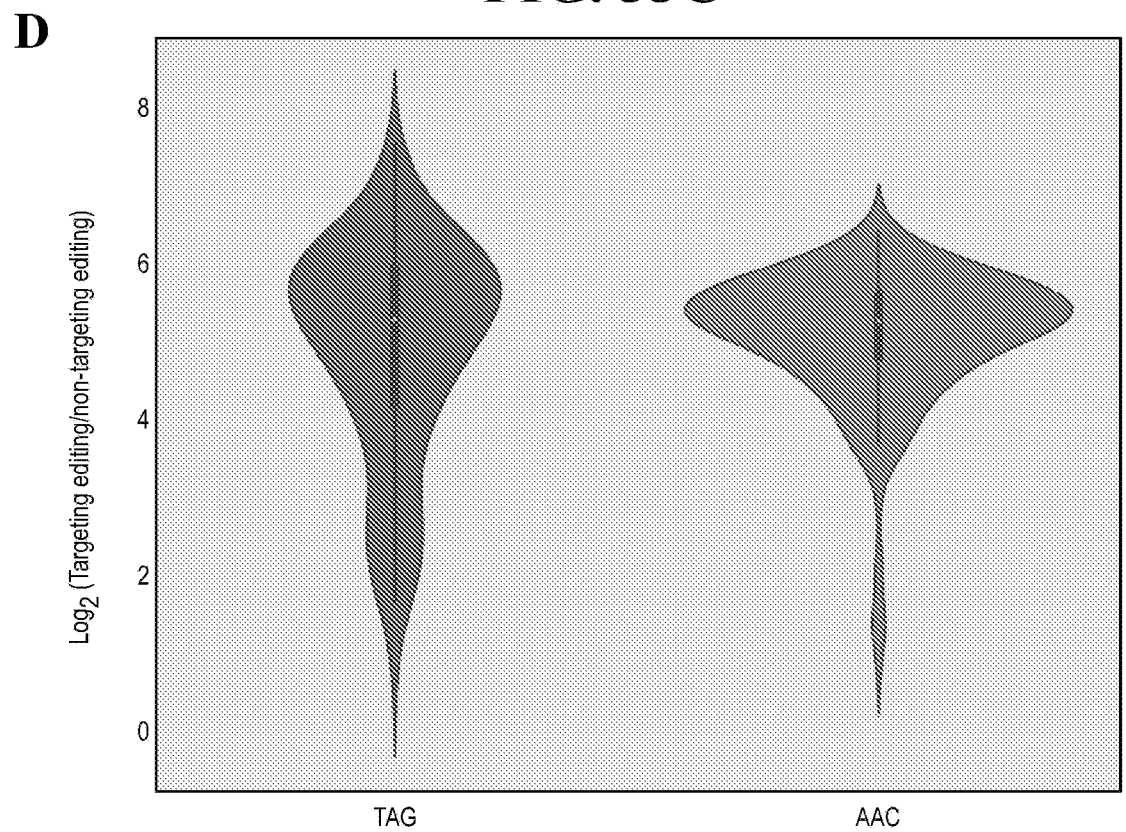
Figure 34:
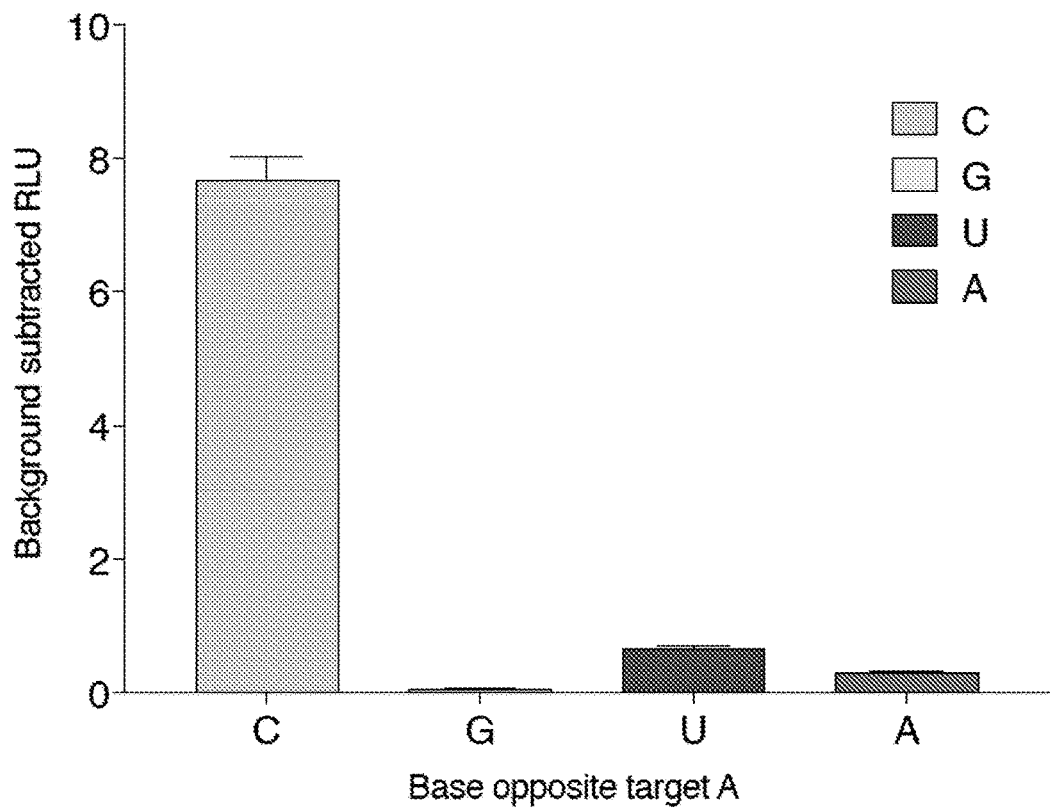
FIG. 34: Reducing off-target editing in the target transcript.
Figure 35:
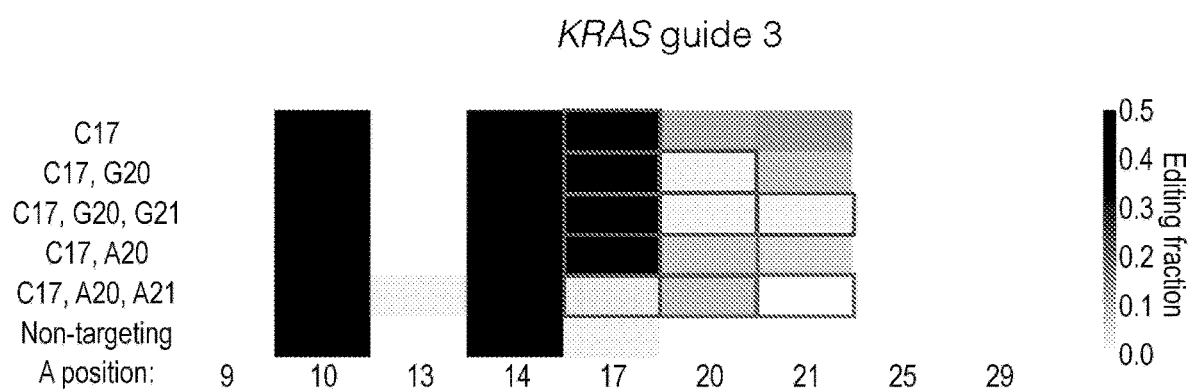
FIG. 35: Reducing off-target editing in the target transcript.
Figure 36A:
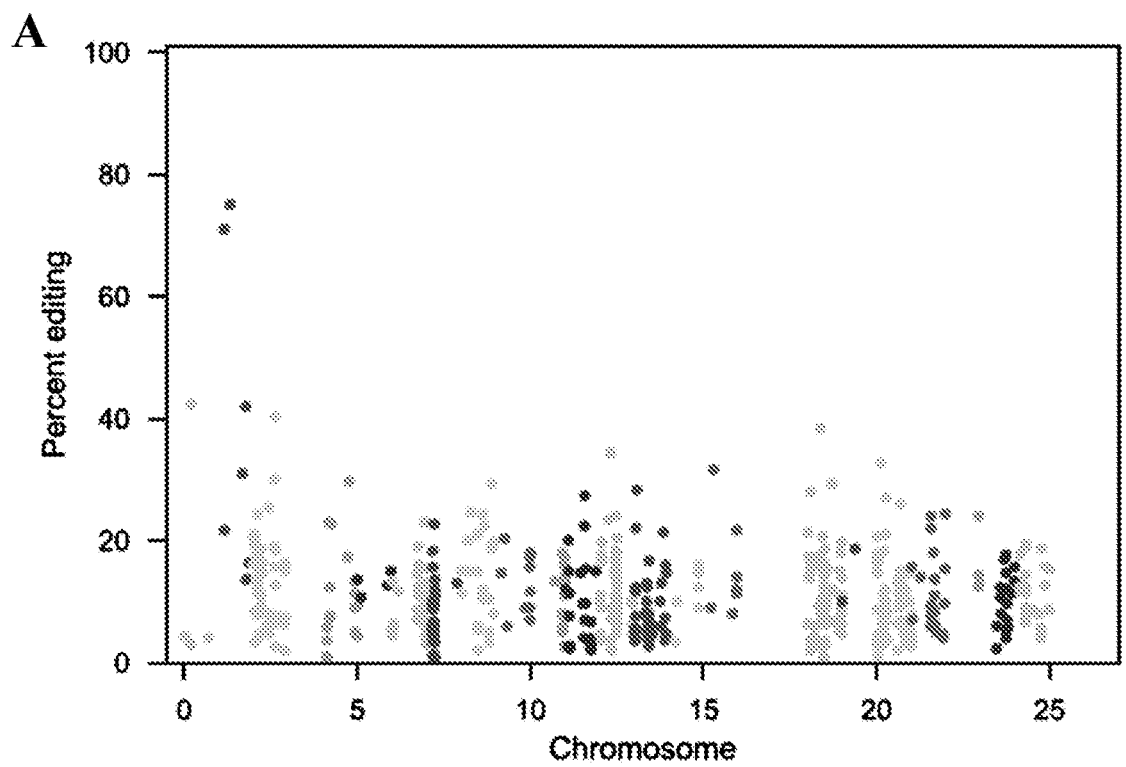
FIGS. 36A-36B: Cas13b-ADAR transcriptome specificity. On-target editing is 71%.
Figure 36B:
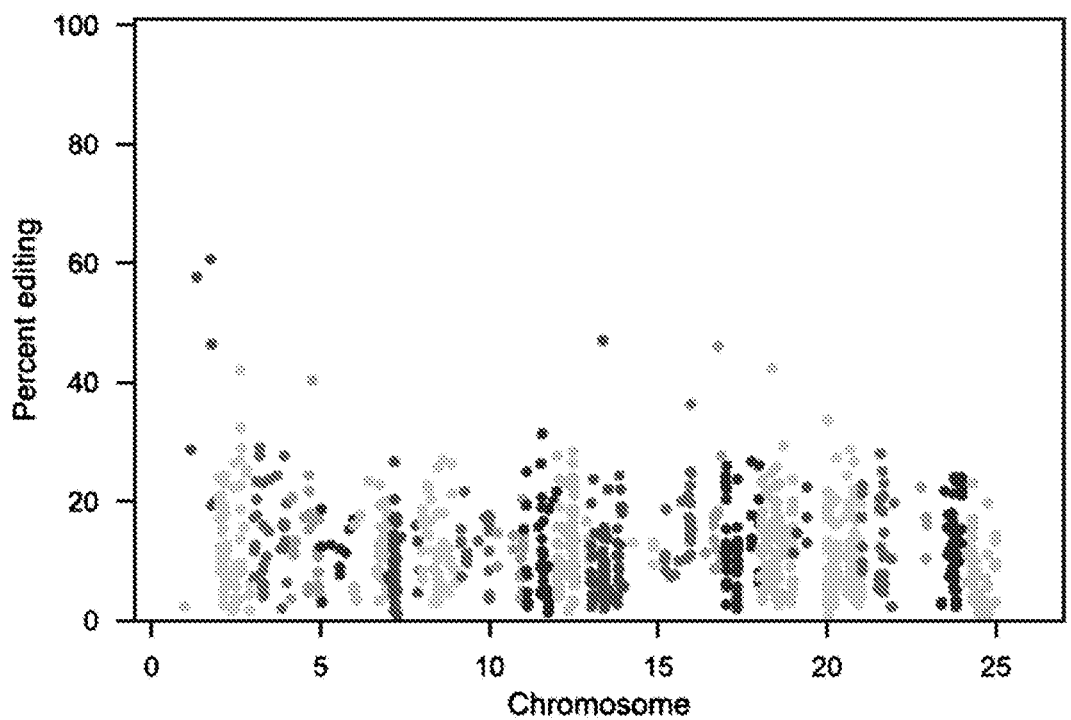
Figure 38:
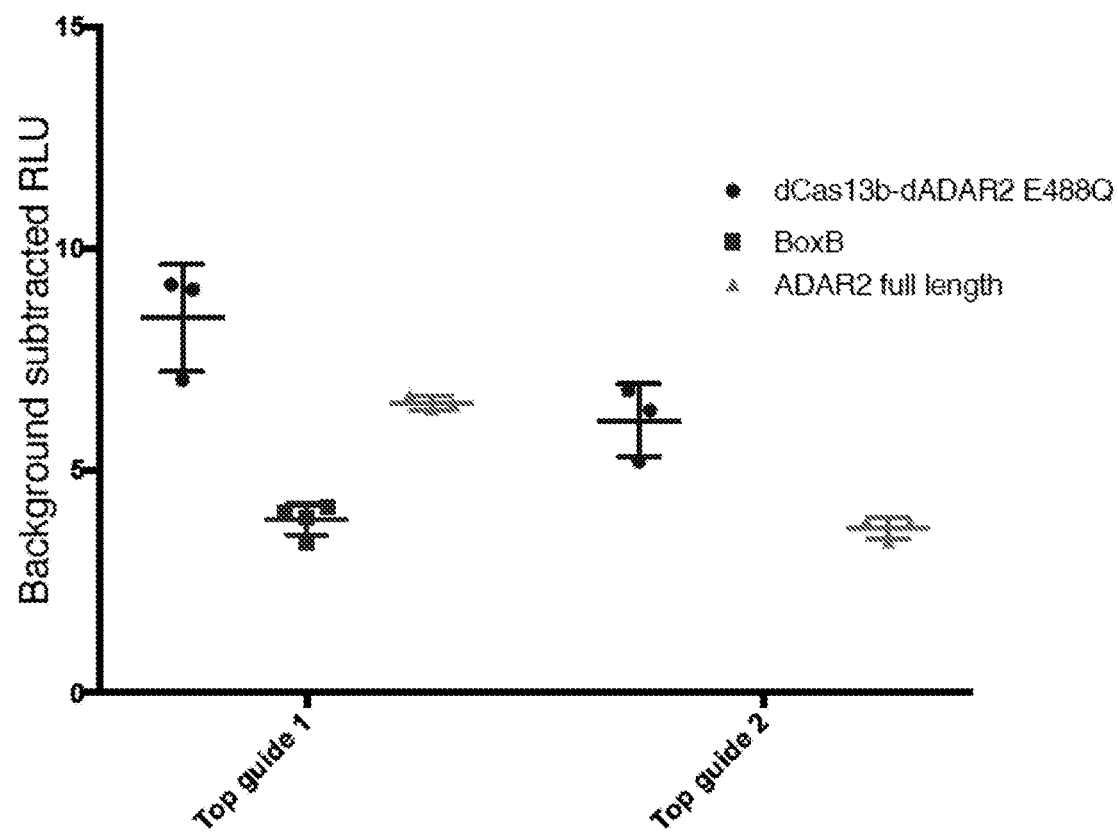
FIG. 38: Cas13b has the highest efficiency compared to competing ADAR editing strategies.
Figure 39A:
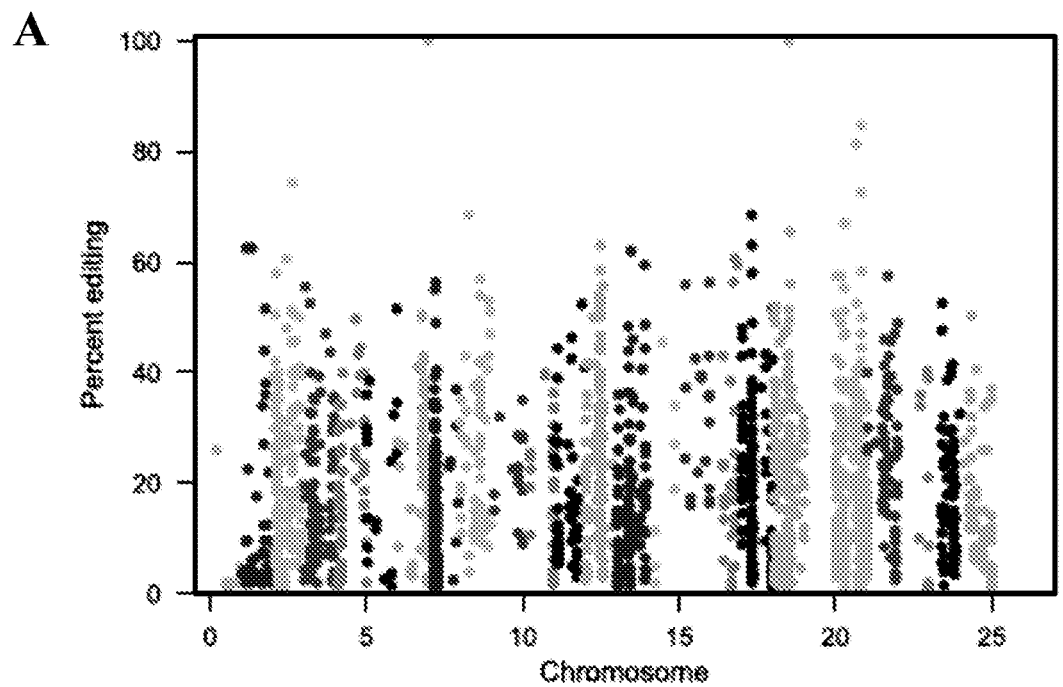
FIGS. 39A-39D: Competing RNA editing systems. (A-B) BoxB; on-target editing is 63%.
Figure 39B:
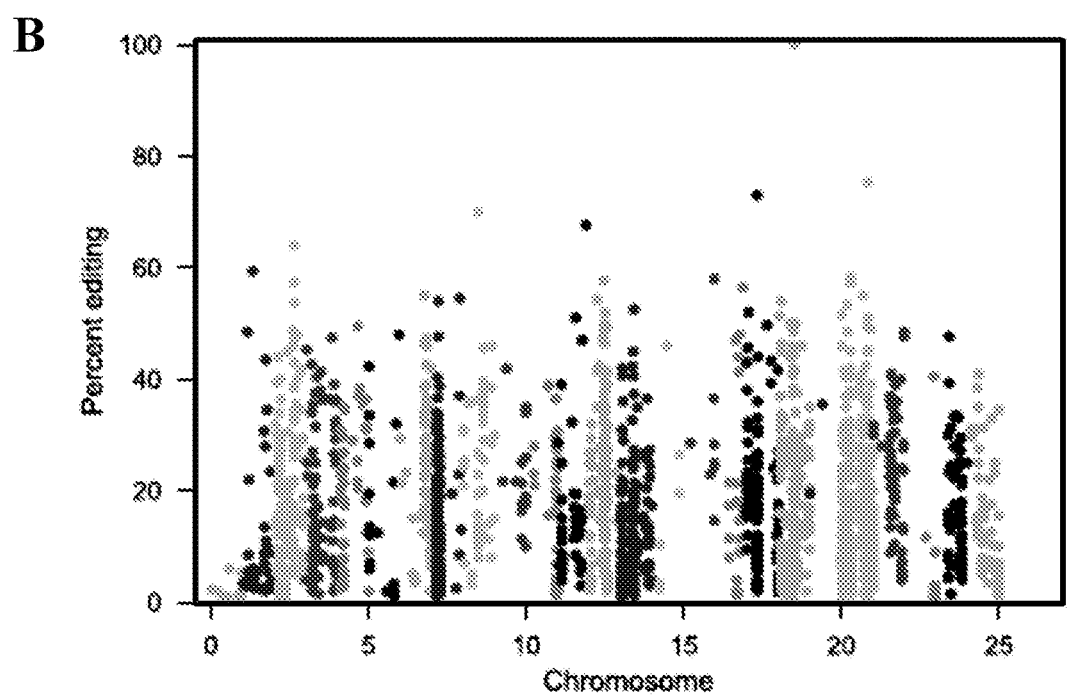
Figure 39C:
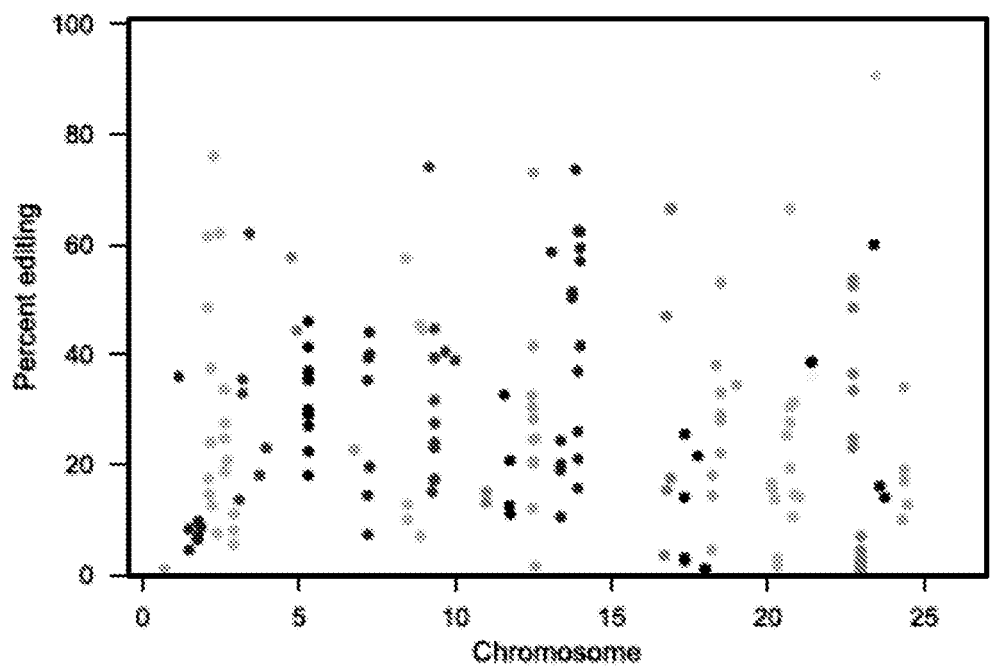
Figure 39D:
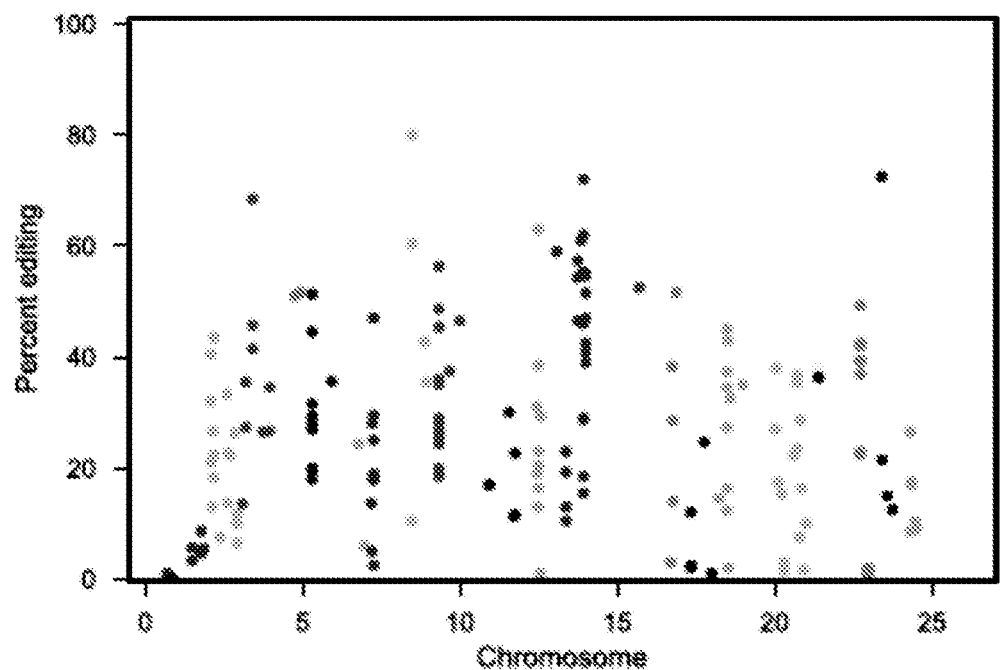
Figure 40:
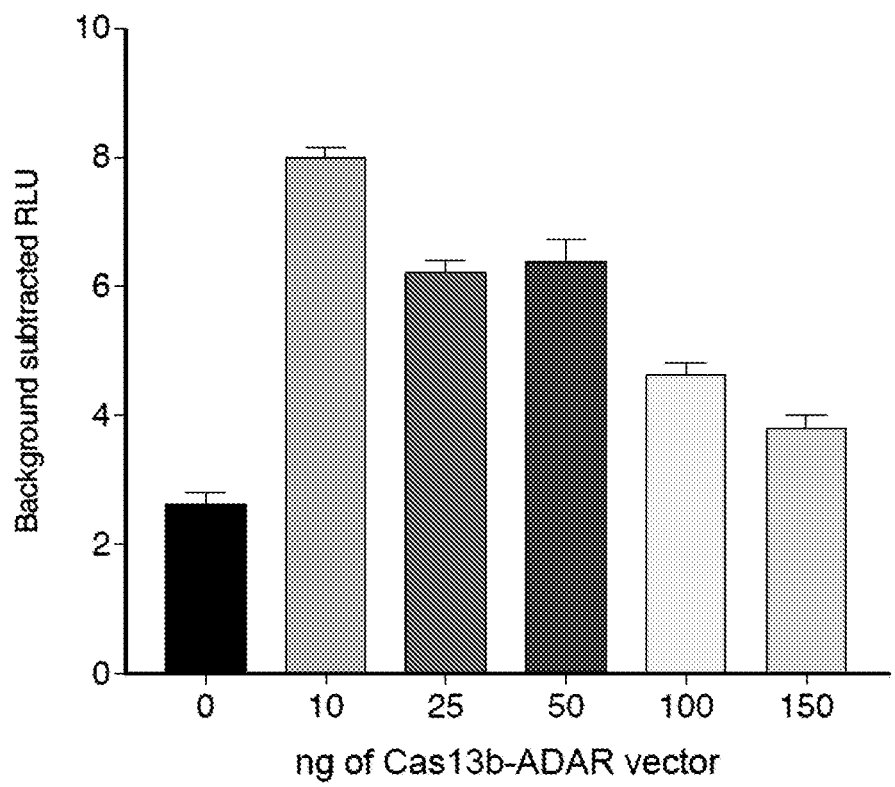
FIG. 40: Dose titration of ADAR. crRNA amount is constant.
Figure 41A:
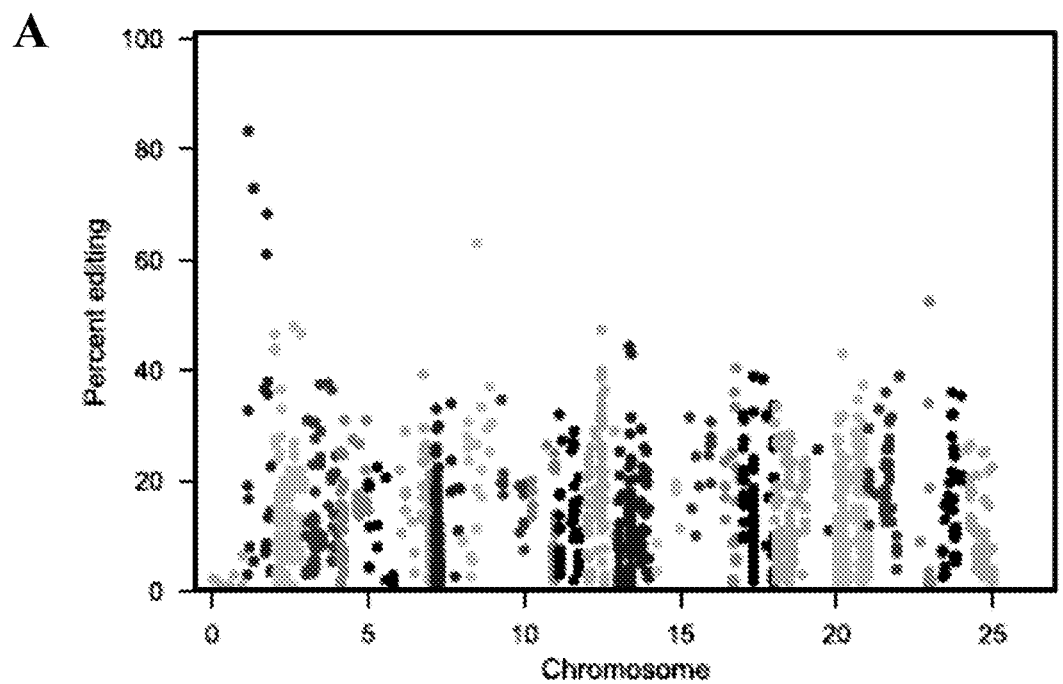
FIGS. 41A-41D: Dose response effect on specificity.
Figure 41B:
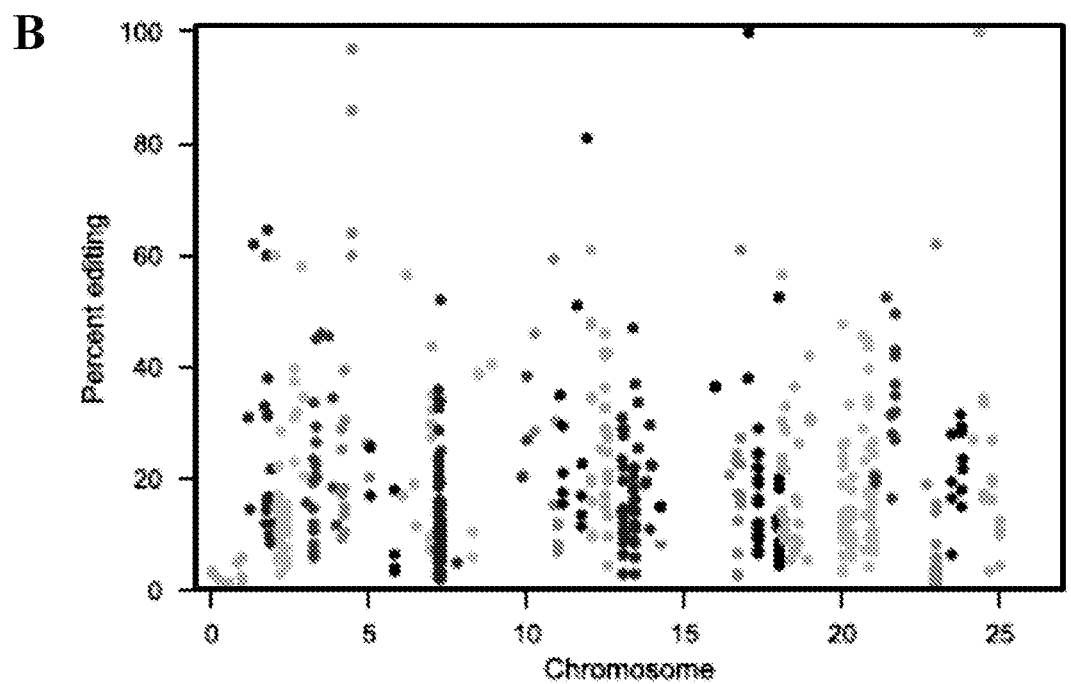
Figure 41C:
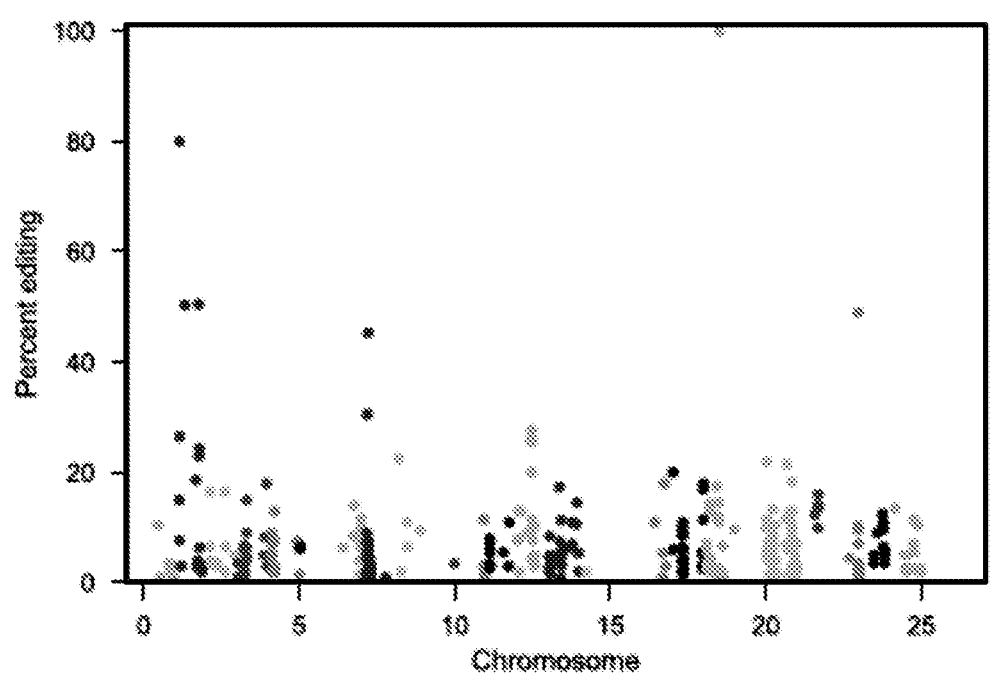
Figure 41D:
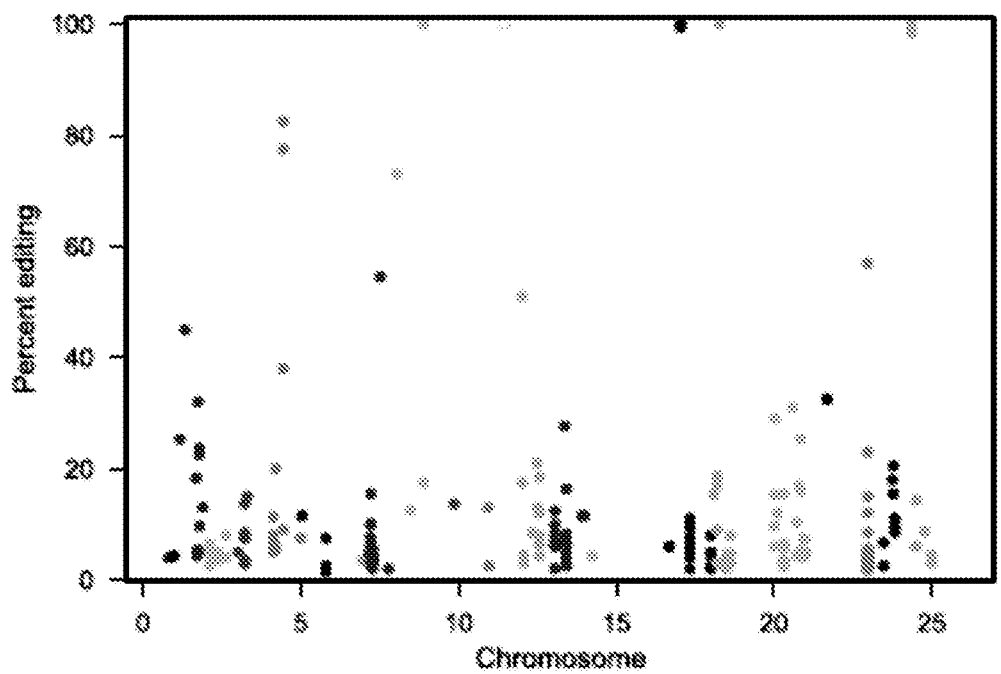
Figure 42A:
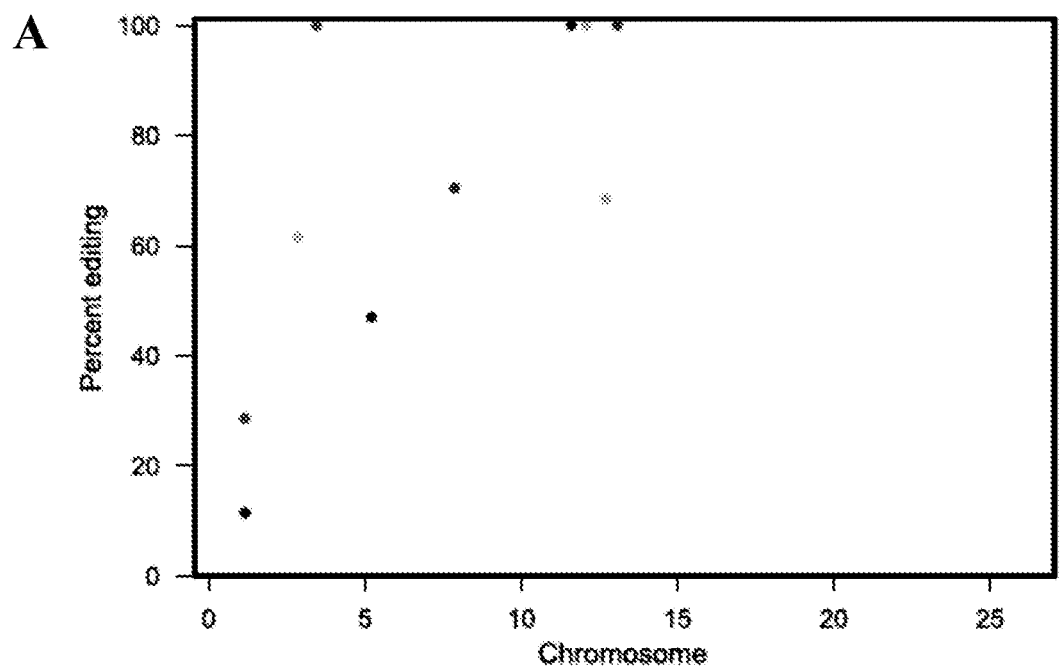
FIGS. 42A-42B: ADAR1 seems more specific than ADAR2. On-target editing is 29%.
Figure 42B:
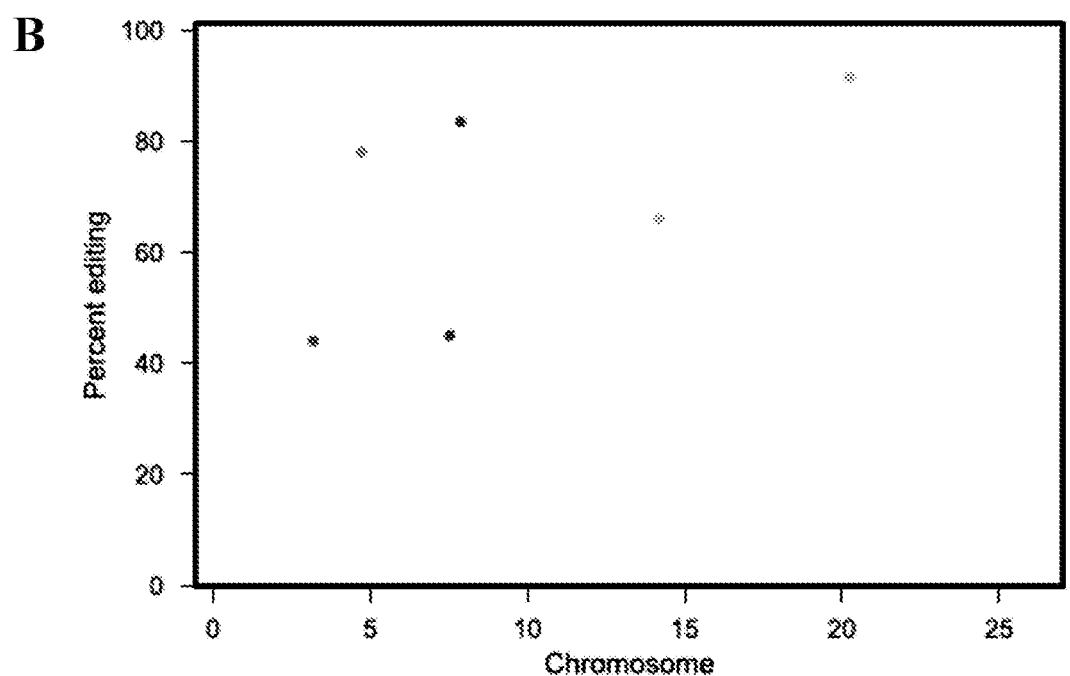
Figure 43A:
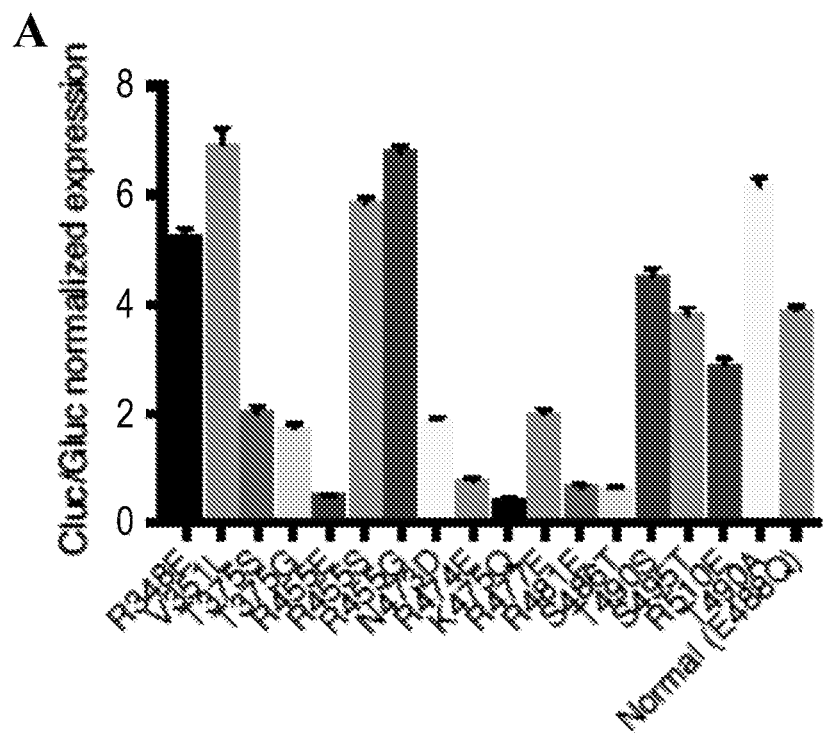
FIGS. 43A-43D: ADAR specificity mutants have enhanced specificity.
Figure 43B:
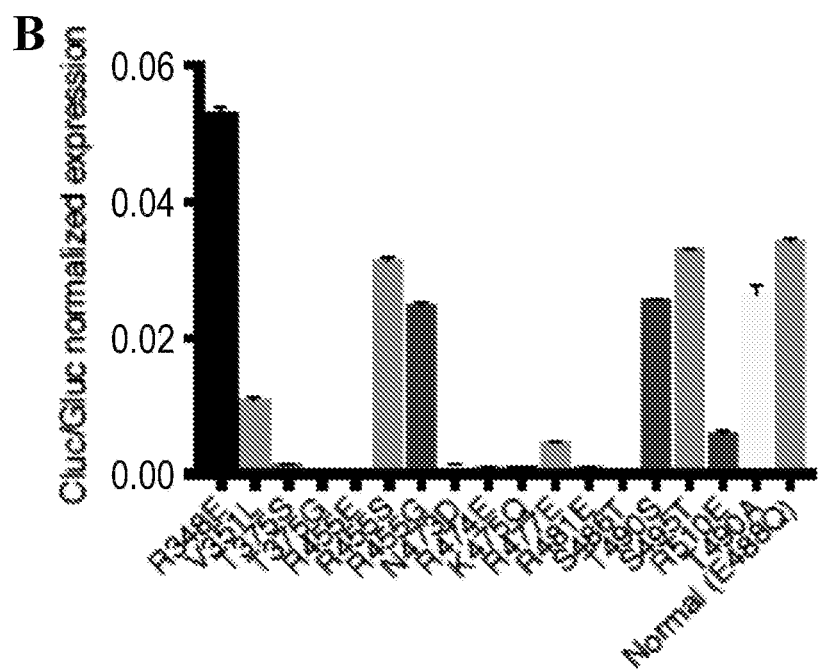
Figure 43C:
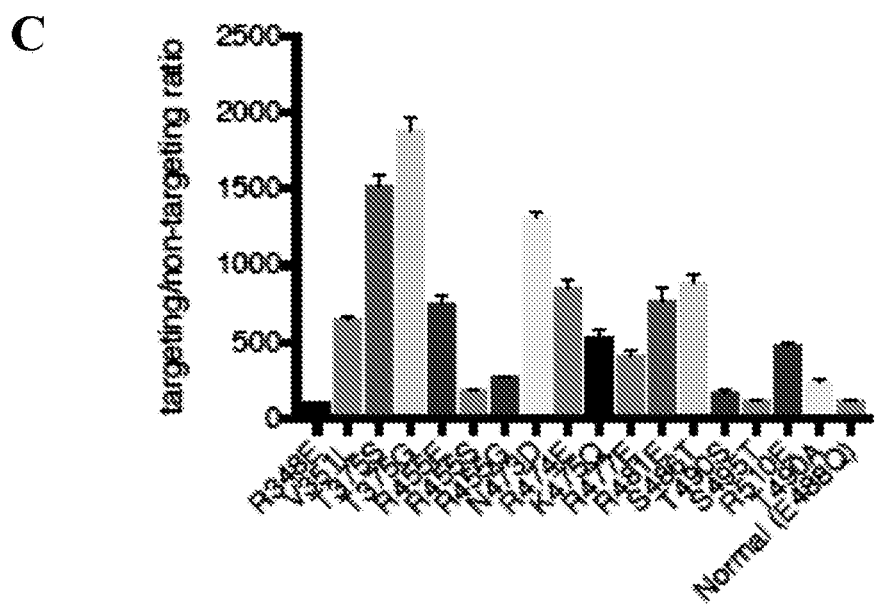
Figure 43D:
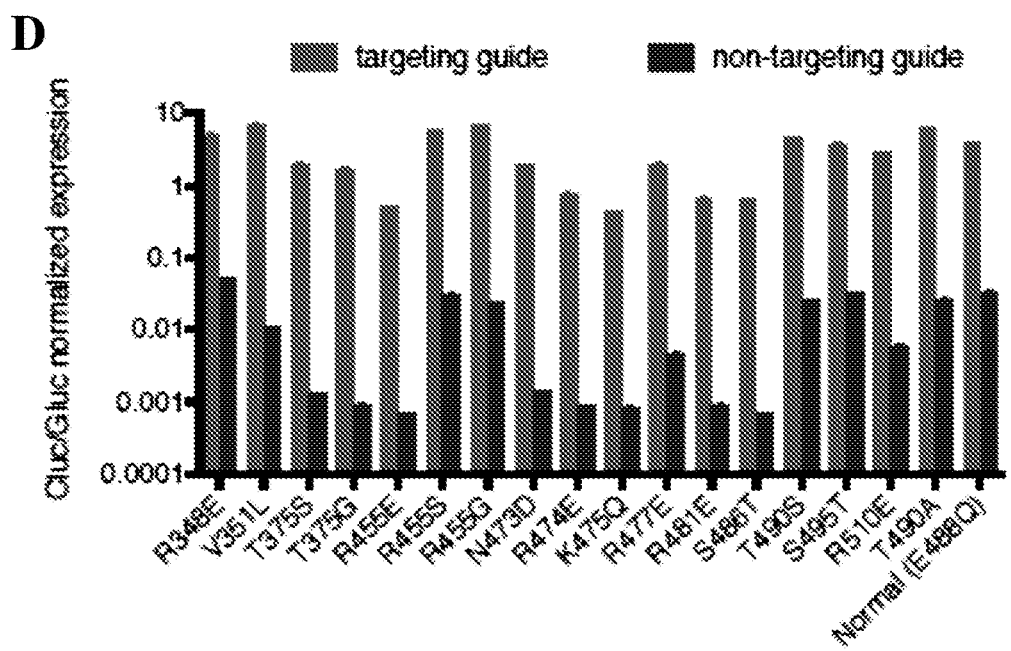
Figure 44:
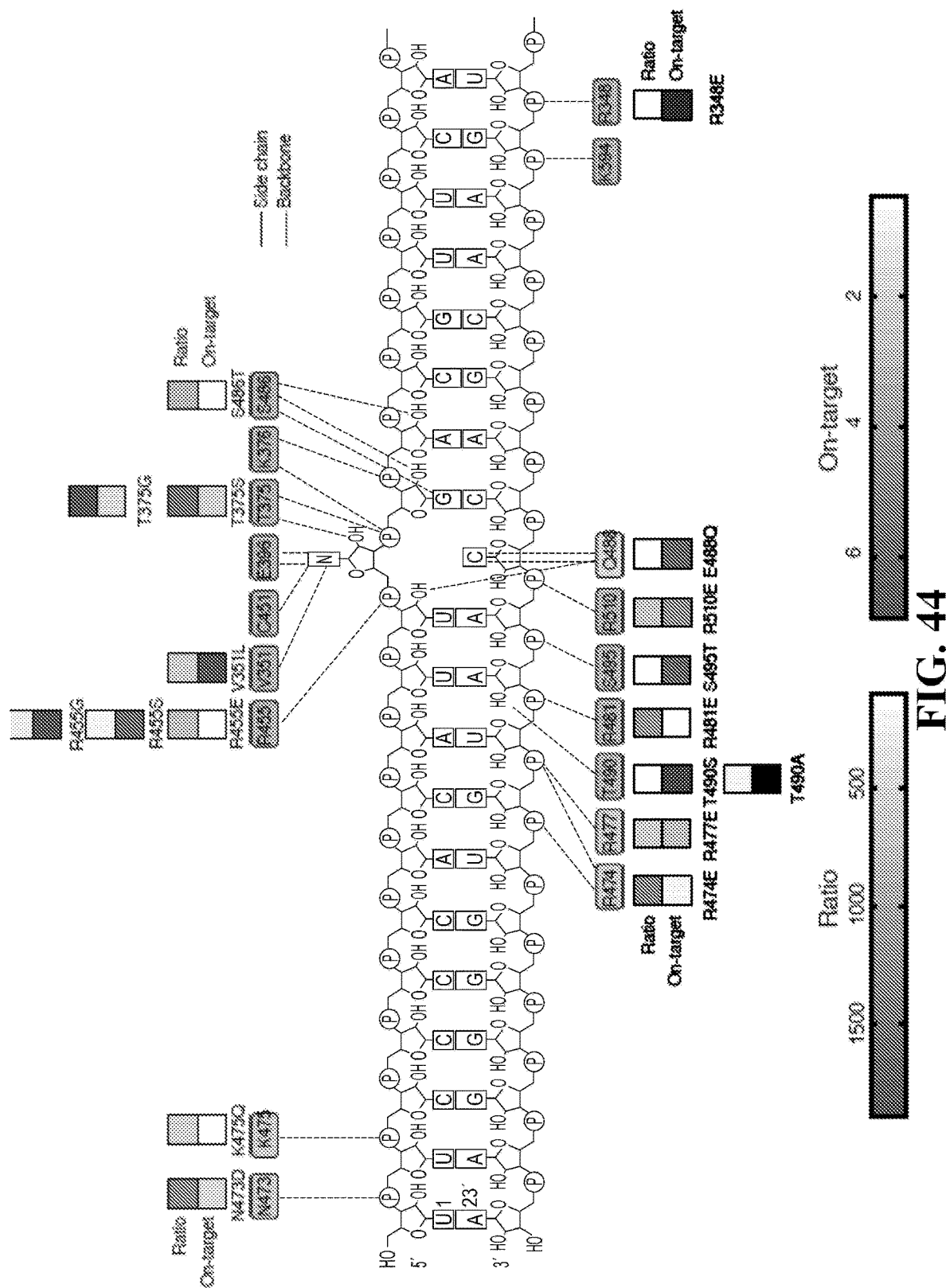
FIG. 44: ADAR mutant luciferase results plotted along the contact points of each residue with the RNA target. Shown are SEQ ID No. 704 and 735.
Figure 45:
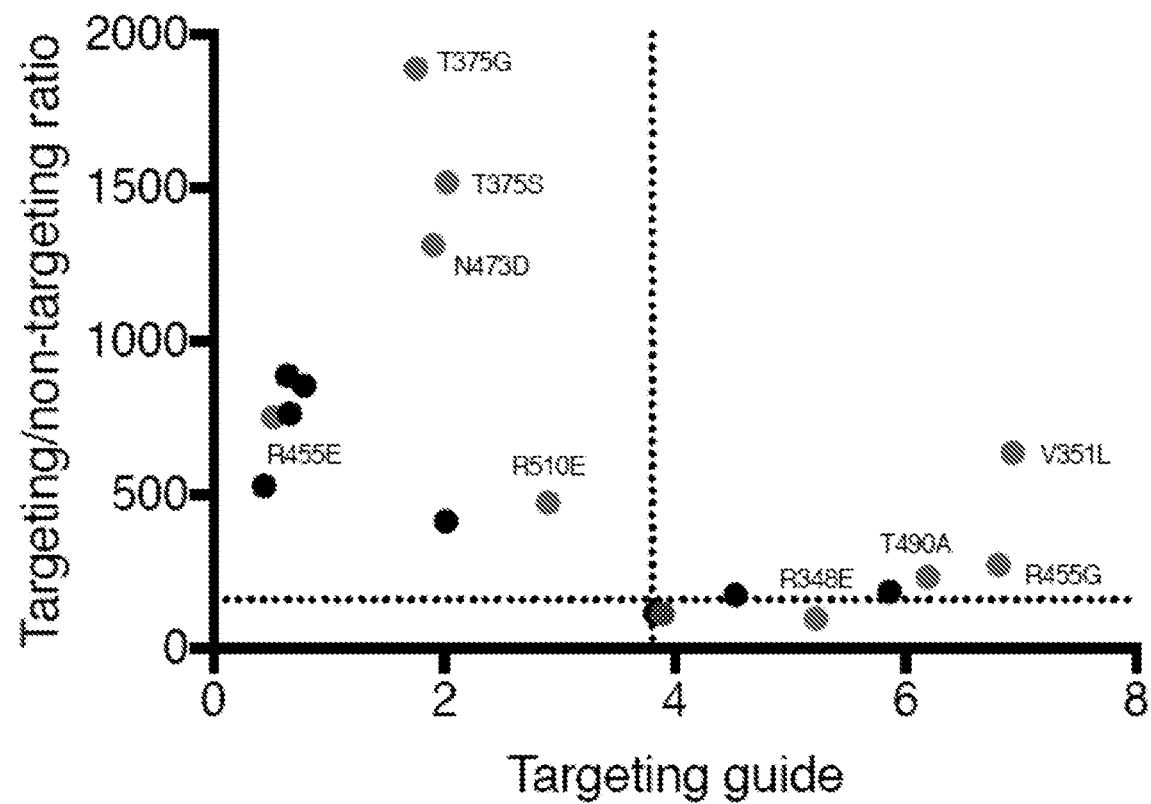
FIG. 45: ADAR specificity mutants have enhanced specificity. Purple points are mutants selected for whole transcriptome off-target NGS analysis. Red point is the starting point (i.e. E488Q mutant). Note that all additional mutants also have the E488Q mutation.
Figure 46A:
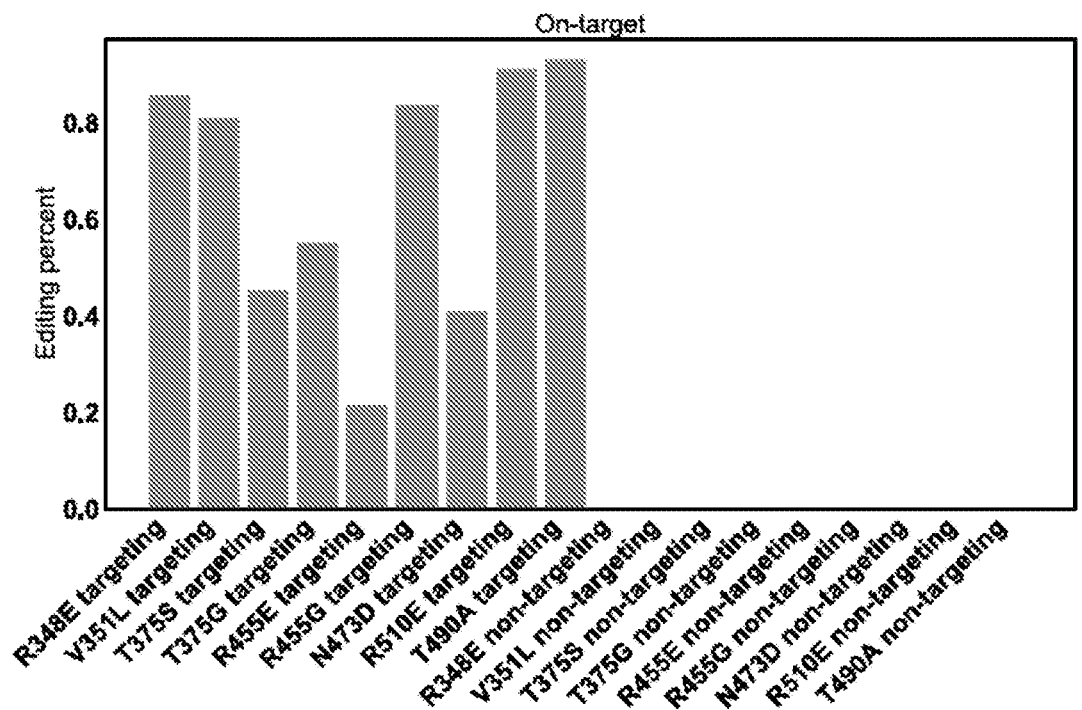
FIGS. 46A-46B: ADAR mutants are more specific according to NGS.
Figure 46B:
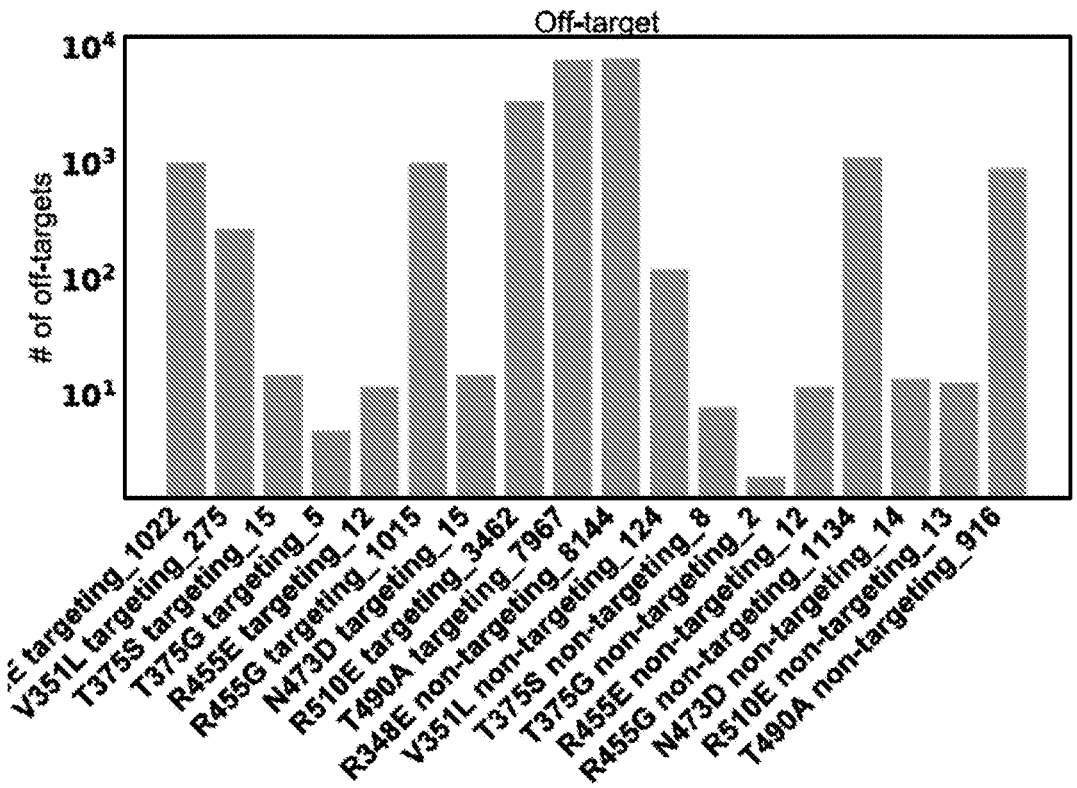
Figure 47A:
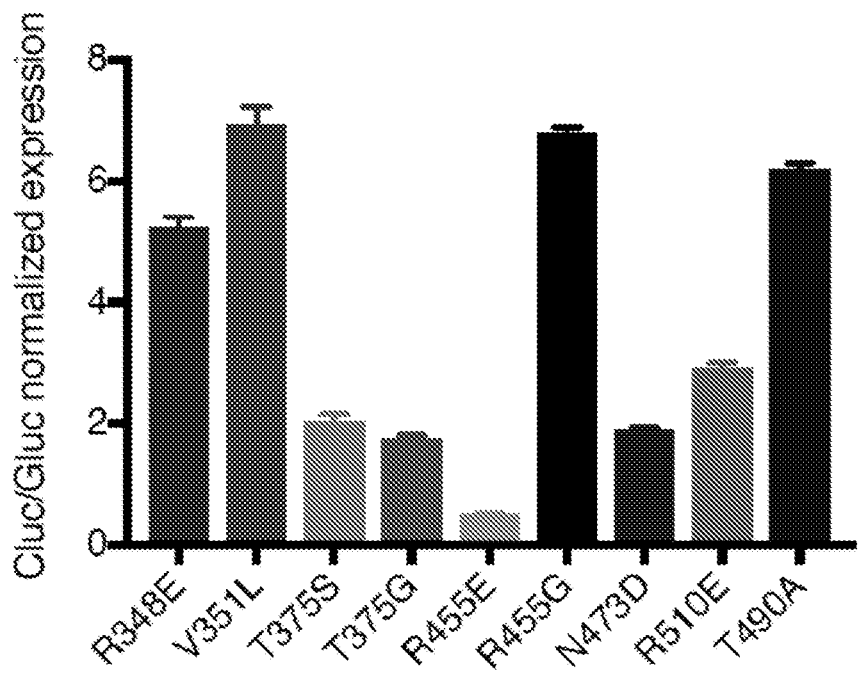
FIGS. 47A-47B: Luciferase data on ADAR specificity mutants matches the NGS.
Figure 47B:
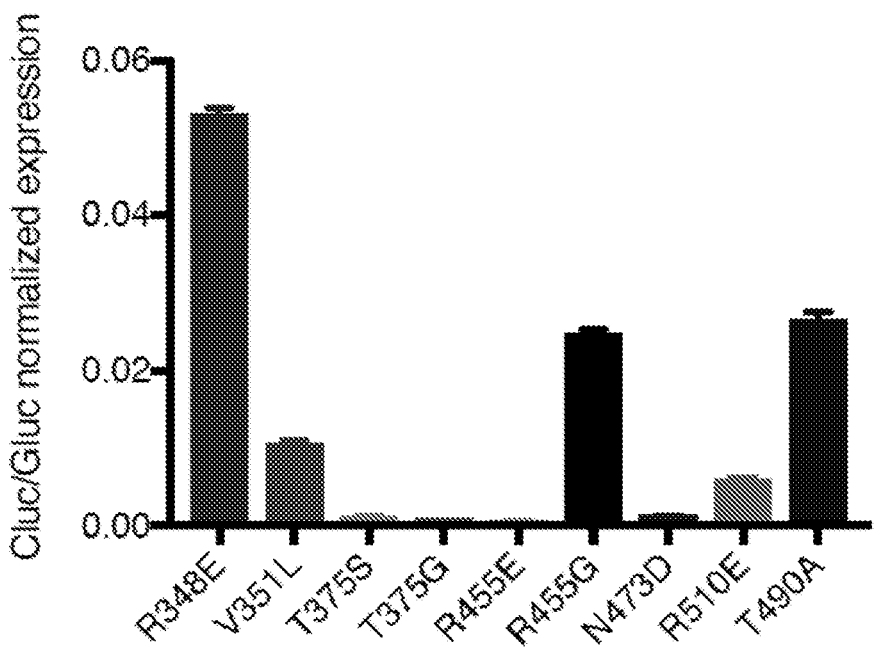
Figure 48A:
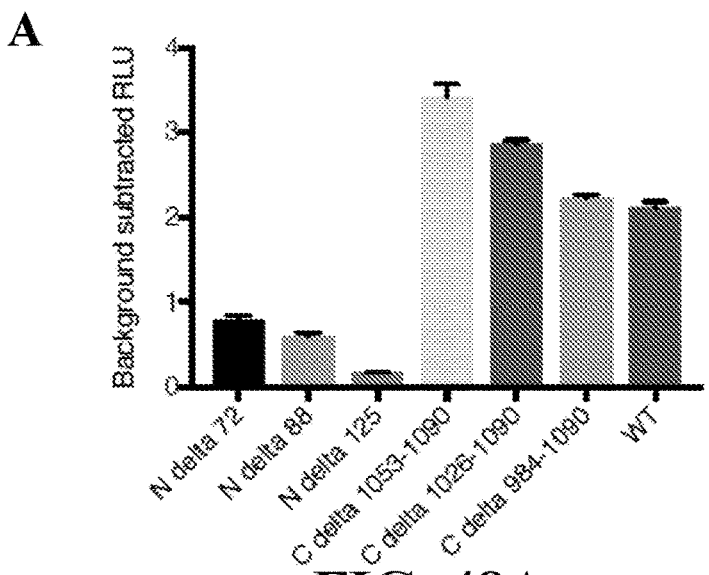
FIGS. 48A-48C: C-terminal truncations of Cas13b 12 are still highly active in ADAR editing.
Figure 48B:
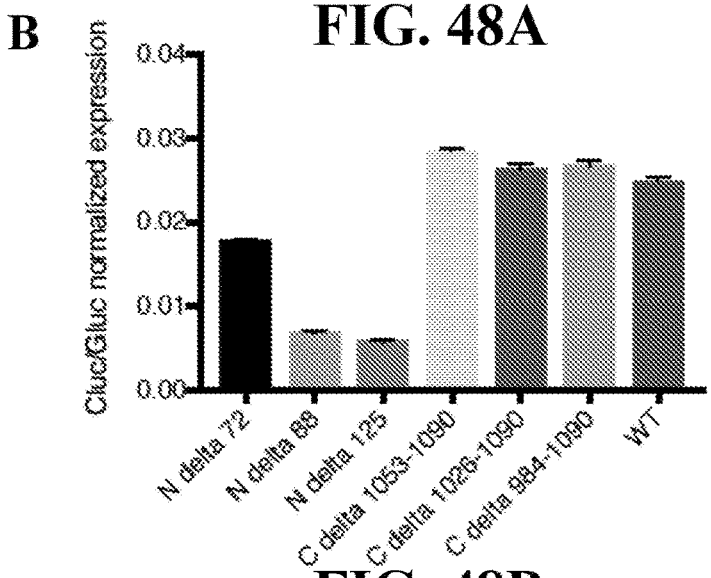
Figure 48C:
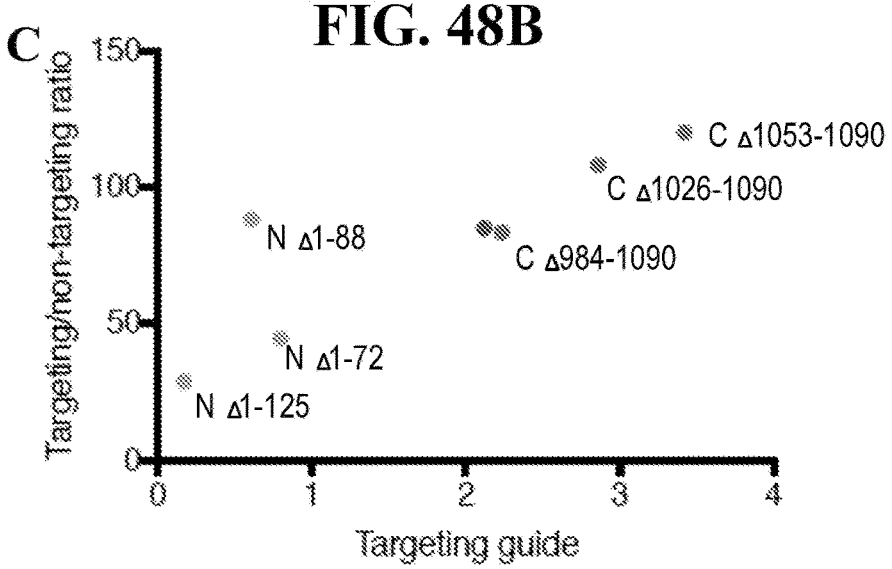

Results suggest that As opposite Cs in the targeting window of the ADAR deaminase domain are preferentially edited over other bases. Additionally, As base-paired with Us within a few bases of the targeted base show low levels of editing by Cas13b-ADAR fusions, suggesting that there is flexibility for the enzyme to edit multiple As (FIG. 19). These two observations suggest that multiple As in the activity window of Cas13b-ADAR fusions could be specified for editing by mismatching all As to be edited with Cs. To test this the most promising guides from the optimization experiment are taken and multiple A:C mismatches in the activity window are designed to test the possibility of creating multiple A:I edits. The editing rates for this experiment is quantified using NGS. To suppress potential off-target editing in the activity window, non-target As are paired with As or Gs (depending on the results from the base preference experiment).

Guide Length Titration for RNA Editing

ADAR naturally works on inter- or intra-molecular RNA duplexes of >20 bp in length (see also Nishikura et al. (2010), Annu Rev Biochem, 79:321-349). The results demonstrated that longer crRNAs, resulting in longer duplexes, had higher levels of activity. To systematically compare the activity of guides of different lengths for RNA editing activity we have designed guides of 30, 50, 70 and 84 bases to correct the stop codon in our luciferase reporter assay (FIGS. 20A-20F and Table below). We have designed these guides such that the position of the edited A is present at all possible even distances within the mRNA:crRNA duplex with respect to the 3' end of the specificity determining region of the crRNA (i.e. +2, +4 etc.).

| Sequence Name | Sequence |
|---|---|
| Guide_Cas13bC-luc_30_ADAR0Top (SEQ ID No. 179) | GCATCCTGCGGCCTCTACTCTGCATTCAATT |
| Guide_Cas13bC-luc_30_ADAR1Top (SEQ ID No. 180) | GACCATCCTGCGGCCTCTACTCTGCATTCAA |

-continued

| Sequence Name | Sequence |
|---|---|
| Guide_Cas13bC-luc_30_ADAR2Top (SEQ ID No. 181) | GAAACCATCCTGCGGCCTCTACTCTGCATTC |
| Guide_Cas13bC-luc_30_ADAR3Top (SEQ ID No. 182) | GCTAAACCATCCTGCGGCCTCTACTCTGCAT |
| Guide_Cas13bC-luc_30_ADAR4Top (SEQ ID No. 183) | GTTCTAAACCATCCTGCGGCCTCTACTCTGC |
| Guide_Cas13bC-luc_30_ADAR5Top (SEQ ID No. 184) | GTGTTCTAAACCATCCTGCGGCCTCTACTCT |
| Guide_Cas13bC-luc_30_ADAR6Top (SEQ ID No. 185) | GAATGTTCTAAACCATCCTGCGGCCTCTACT |
| Guide_Cas13bC-luc_30_ADAR7Top (SEQ ID No. 186) | GAGAATGTTCTAAACCATCCTGCGGCCTCTA |
| Guide_Cas13bC-luc_30_ADAR8Top (SEQ ID No. 187) | GATAGAATGTTCTAAACCATCCTGCGGCCTC |
| Guide_Cas13bC-luc_30_ADAR9Top (SEQ ID No. 188) | GCCATAGAATGTTCTAAACCATCCTGCGGCC |
| Guide_Cas13bC-luc_30_ADAR10Top (SEQ ID No. 189) | GTTCCATAGAATGTTCTAAACCATCCTGCGG |
| Guide_Cas13bC-luc_30_ADAR11Top (SEQ ID No. 190) | GCTTTCCATAGAATGTTCTAAACCATCCTGC |
| Guide_Cas13bC-luc_30_ADAR12Top (SEQ ID No. 191) | GCTCTTTCCATAGAATGTTCTAAACCATCCT |
| Guide_Cas13bC-luc_30_ADAR13Top (SEQ ID No. 192) | GATCTCTTTCCATAGAATGTTCTAAACCATC |
| Guide_Cas13bC-luc_30_ADAR14Top (SEQ ID No. 193) | GGAATCTCTTTCCATAGAATGTTCTAAACCA |
| Guide_Cas13bC-luc_50_ADAR0Top (SEQ ID No. 194) | GCATCCTGCGGCCTCTACTCTGCATTCAATTACATACTGACACATTCGGCA |
| Guide_Cas13bC-luc_50_ADAR1Top (SEQ ID No. 195) | GACCATCCTGCGGCCTCTACTCTGCATTCAATTACATACTGACACATTCGG |
| Guide_Cas13bC-luc_50_ADAR2Top (SEQ ID No. 196) | GAAACCATCCTGCGGCCTCTACTCTGCATTCAATTACATACTGACACATTC |
| Guide_Cas13bC-luc_50_ADAR3Top (SEQ ID No. 197) | GCTAAACCATCCTGCGGCCTCTACTCTGCATTCAATTACATACTGACACAT |
| Guide_Cas13bC-luc_50_ADAR4Top (SEQ ID No. 198) | GTTCTAAACCATCCTGCGGCCTCTACTCTGCATTCAATTACATACTGACAC |
| Guide_Cas13bC-luc_50_ADAR5Top (SEQ ID No. 199) | GTGTTCTAAACCATCCTGCGGCCTCTACTCTGCATTCAATTACATACTGAC |

-continued

| Sequence Name | Sequence |
|---|---|
| Guide_Cas13bC-luc_50_ADAR6Top (SEQ ID No. 200) | GAATGTTCTAAACCATCCTGCGGCCTCTACTCTGCATTCAATTACATACTG |
| Guide_Cas13bC-luc_50_ADAR7Top (SEQ ID No. 201) | GAGAATGTTCTAAACCATCCTGCGGCCTCTACTCTGCATTCAATTACATAC |
| Guide_Cas13bC-luc_50_ADAR8Top (SEQ ID No. 202) | GATAGAATGTTCTAAACCATCCTGCGGCCTCTACTCTGCATTCAATTACAT |
| Guide_Cas13bC-luc_50_ADAR9Top (SEQ ID No. 203) | GCCATAGAATGTTCTAAACCATCCTGCGGCCTCTACTCTGCATTCAATTAC |
| Guide_Cas13bC-luc_50_ADAR10Top (SEQ ID No. 204) | GTTCCATAGAATGTTCTAAACCATCCTGCGGCCTCTACTCTGCATTCAATT |
| Guide_Cas13bC-luc_50_ADAR11Top (SEQ ID No. 205) | GCTTTCCATAGAATGTTCTAAACCATCCTGCGGCCTCTACTCTGCATTCAA |
| Guide_Cas13bC-luc_50_ADAR12Top (SEQ ID No. 206) | GCTCTTTCCATAGAATGTTCTAAACCATCCTGCGGCCTCTACTCTGCATTC |
| Guide_Cas13bC-luc_50_ADAR13Top (SEQ ID No. 207) | GATCTCTTTCCATAGAATGTTCTAAACCATCCTGCGGCCTCTACTCTGCAT |
| Guide_Cas13bC-luc_50_ADAR14Top (SEQ ID No. 208) | GGAATCTCTTTCCATAGAATGTTCTAAACCATCCTGCGGCCTCTACTCTGC |
| Guide_Cas13bC-luc_50_ADAR15Top (SEQ ID No. 209) | GTGGAATCTCTTTCCATAGAATGTTCTAAACCATCCTGCGGCCTCTACTCT |
| Guide_Cas13bC-luc_50_ADAR16Top (SEQ ID No. 210) | GACTGGAATCTCTTTCCATAGAATGTTCTAAACCATCCTGCGGCCTCTACT |
| Guide_Cas13bC-luc_50_ADAR17Top (SEQ ID No. 211) | GGAACTGGAATCTCTTTCCATAGAATGTTCTAAACCATCCTGCGGCCTCTA |
| Guide_Cas13bC-luc_50_ADAR18Top (SEQ ID No. 212) | GTGGAACTGGAATCTCTTTCCATAGAATGTTCTAAACCATCCTGCGGCCTC |
| Guide_Cas13bC-luc_50_ADAR19Top (SEQ ID No. 213) | GCCTGGAACTGGAATCTCTTTCCATAGAATGTTCTAAACCATCCTGCGGCC |
| Guide_Cas13bC-luc_50_ADAR20Top (SEQ ID No. 214) | GTTCCTGGAACTGGAATCTCTTTCCATAGAATGTTCTAAACCATCCTGCGG |
| Guide_Cas13bC-luc_50_ADAR21Top (SEQ ID No. 215) | GGGTTCCTGGAACTGGAATCTCTTTCCATAGAATGTTCTAAACCATCCTGC |
| Guide_Cas13bC-luc_50_ADAR22Top (SEQ ID No. 216) | GCAGGTTCCTGGAACTGGAATCTCTTTCCATAGAATGTTCTAAACCATCCT |
| Guide_Cas13bC-luc_50_ADAR23Top (SEQ ID No. 217) | GACCAGGTTCCTGGAACTGGAATCTCTTTCCATAGAATGTTCTAAACCATC |
| Guide_Cas13bC-luc_50_ADAR24Top (SEQ ID No. 218) | GGTACCAGGTTCCTGGAACTGGAATCTCTTTCCATAGAATGTTCTAAACCA |

| Sequence Name | Sequence |
|---|---|
| Guide_Cas13bC-luc_70_ADAR0Top (SEQ ID No. 219) | GCATCCTGCGGCCTCTACTCTGCATTCAATTACATACTGACACATTCGGCAACATGTTTTTCCTGGTTTAT |
| Guide_Cas13bC-luc_70_ADAR1Top (SEQ ID No. 220) | GACCATCCTGCGGCCTCTACTCTGCATTCAATTACATACTGACACATTCGGCAACATGTTTTTCCTGGTTT |
| Guide_Cas13bC-luc_70_ADAR2Top (SEQ ID No. 221) | GAAACCATCCTGCGGCCTCTACTCTGCATTCAATTACATACTGACACATTCGGCAACATGTTTTTCCTGGT |
| Guide_Cas13bC-luc_70_ADAR3Top (SEQ ID No. 222) | GCTAAACCATCCTGCGGCCTCTACTCTGCATTCAATTACATACTGACACATTCGGCAACATGTTTTTCCTG |
| Guide_Cas13bC-luc_70_ADAR4Top (SEQ ID No. 223) | GTTCTAAACCATCCTGCGGCCTCTACTCTGCATTCAATTACATACTGACACATTCGGCAACATGTTTTTCC |
| Guide_Cas13bC-luc_70_ADAR5Top (SEQ ID No. 224) | GTGTTCTAAACCATCCTGCGGCCTCTACTCTGCATTCAATTACATACTGACACATTCGGCAACATGTTTTT |
| Guide_Cas13bC-luc_70_ADAR6Top (SEQ ID No. 225) | GAATGTTCTAAACCATCCTGCGGCCTCTACTCTGCATTCAATTACATACTGACACATTCGGCAACATGTTT |
| Guide_Cas13bC-luc_70_ADAR7Top (SEQ ID No. 226) | GAGAATGTTCTAAACCATCCTGCGGCCTCTACTCTGCATTCAATTACATACTGACACATTCGGCAACATGT |
| Guide_Cas13bC-luc_70_ADAR8Top (SEQ ID No. 227) | GATAGAATGTTCTAAACCATCCTGCGGCCTCTACTCTGCATTCAATTACATACTGACACATTCGGCAACAT |
| Guide_Cas13bC-luc_70_ADAR9Top (SEQ ID No. 228) | GCCATAGAATGTTCTAAACCATCCTGCGGCCTCTACTCTGCATTCAATTACATACTGACACATTCGGCAAC |
| Guide_Cas13bC-luc_70_ADAR10Top (SEQ ID No. 229) | GTTCCATAGAATGTTCTAAACCATCCTGCGGCCTCTACTCTGCATTCAATTACATACTGACACATTCGGCA |
| Guide_Cas13bC-luc_70_ADAR11Top (SEQ ID No. 230) | GCTTTCCATAGAATGTTCTAAACCATCCTGCGGCCTCTACTCTGCATTCAATTACATACTGACACATTCGG |
| Guide_Cas13bC-luc_70_ADAR12Top (SEQ ID No. 231) | GCTCTTTCCATAGAATGTTCTAAACCATCCTGCGGCCTCTACTCTGCATTCAATTACATACTGACACATTC |
| Guide_Cas13bC-luc_70_ADAR13Top (SEQ ID No. 232) | GATCTCTTTCCATAGAATGTTCTAAACCATCCTGCGGCCTCTACTCTGCATTCAATTACATACTGACACAT |
| Guide_Cas13bC-luc_70_ADAR14Top (SEQ ID No. 233) | GGAATCTCTTTCCATAGAATGTTCTAAACCATCCTGCGGCCTCTACTCTGCATTCAATTACATACTGACAC |
| Guide_Cas13bC-luc_70_ADAR15Top (SEQ ID No. 234) | GTGGAATCTCTTTCCATAGAATGTTCTAAACCATCCTGCGGCCTCTACTCTGCATTCAATTACATACTGAC |
| Guide_Cas13bC-luc_70_ADAR16Top (SEQ ID No. 235) | GACTGGAATCTCTTTCCATAGAATGTTCTAAACCATCCTGCGGCCTCTACTCTGCATTCAATTACATACTG |
| Guide_Cas13bC-luc_70_ADAR17Top (SEQ ID No. 236) | GGAACTGGAATCTCTTTCCATAGAATGTTCTAAACCATCCTGCGGCCTCTACTCTGCATTCAATTACATAC |
| Guide_Cas13bC-luc_70_ADAR18Top (SEQ ID No. 237) | GTGGAACTGGAATCTCTTTCCATAGAATGTTCTAAACCATCCTGCGGCCTCTACTCTGCATTCAATTACAT |

-continued

| Sequence Name | Sequence |
|---|---|
| Guide_Cas13bC-luc_70_ADAR19Top (SEQ ID No. 238) | GCCTGGAACTGGAATCTCTTTCCATAGAATGTTCTAAACCATCCTGCGGCCTCTACTCTGCATTCAATTAC |
| Guide_Cas13bC-luc_70_ADAR20Top (SEQ ID No. 239) | GTTCCTGGAACTGGAATCTCTTTCCATAGAATGTTCTAAACCATCCTGCGGCCTCTACTCTGCATTCAATT |
| Guide_Cas13bC-luc_70_ADAR21Top (SEQ ID No. 240) | GGGTTCCTGGAACTGGAATCTCTTTCCATAGAATGTTCTAAACCATCCTGCGGCCTCTACTCTGCATTCAA |
| Guide_Cas13bC-luc_70_ADAR22Top (SEQ ID No. 241) | GCAGGTTCCTGGAACTGGAATCTCTTTCCATAGAATGTTCTAAACCATCCTGCGGCCTCTACTCTGCATTC |
| Guide_Cas13bC-luc_70_ADAR23Top (SEQ ID No. 242) | GACCAGGTTCCTGGAACTGGAATCTCTTTCCATAGAATGTTCTAAACCATCCTGCGGCCTCTACTCTGCAT |
| Guide_Cas13bC-luc_70_ADAR24Top (SEQ ID No. 243) | GGTACCAGGTTCCTGGAACTGGAATCTCTTTCCATAGAATGTTCTAAACCATCCTGCGGCCTCTACTCTGC |
| Guide_Cas13bC-luc_70_ADAR25Top (SEQ ID No. 244) | GATGTACCAGGTTCCTGGAACTGGAATCTCTTTCCATAGAATGTTCTAAACCATCCTGCGGCCTCTACTCT |
| Guide_Cas13bC-luc_70_ADAR26Top (SEQ ID No. 245) | GGTATGTACCAGGTTCCTGGAACTGGAATCTCTTTCCATAGAATGTTCTAAACCATCCTGCGGCCTCTACT |
| Guide_Cas13bC-luc_70_ADAR27Top (SEQ ID No. 246) | GACGTATGTACCAGGTTCCTGGAACTGGAATCTCTTTCCATAGAATGTTCTAAACCATCCTGCGGCCTCTA |
| Guide_Cas13bC-luc_70_ADAR28Top (SEQ ID No. 247) | GACACGTATGTACCAGGTTCCTGGAACTGGAATCTCTTTCCATAGAATGTTCTAAACCATCCTGCGGCCTC |
| Guide_Cas13bC-luc_70_ADAR29Top (SEQ ID No. 248) | GCAACACGTATGTACCAGGTTCCTGGAACTGGAATCTCTTTCCATAGAATGTTCTAAACCATCCTGCGGCC |
| Guide_Cas13bC-luc_70_ADAR30Top (SEQ ID No. 249) | GCCCAACACGTATGTACCAGGTTCCTGGAACTGGAATCTCTTTCCATAGAATGTTCTAAACCATCCTGCGG |
| Guide_Cas13bC-luc_70_ADAR31Top (SEQ ID No. 250) | GGACCCAACACGTATGTACCAGGTTCCTGGAACTGGAATCTCTTTCCATAGAATGTTCTAAACCATCCTGC |
| Guide_Cas13bC-luc_70_ADAR32Top (SEQ ID No. 251) | GTTGACCCAACACGTATGTACCAGGTTCCTGGAACTGGAATCTCTTTCCATAGAATGTTCTAAACCATCCT |
| Guide_Cas13bC-luc_70_ADAR33Top (SEQ ID No. 252) | GCCTTGACCCAACACGTATGTACCAGGTTCCTGGAACTGGAATCTCTTTCCATAGAATGTTCTAAACCATC |
| Guide_Cas13bC-luc_70_ADAR34Top (SEQ ID No. 253) | GTTCCTTGACCCAACACGTATGTACCAGGTTCCTGGAACTGGAATCTCTTTCCATAGAATGTTCTAAACCA |
| Guide_Cas13bC-luc_84_ADAR0Top (SEQ ID No. 254) | GCATCCTGCGGCCTCTACTCTGCATTCAATTACATACTGACACATTCGGCAACATGTTTTTCCTGGTTTATTTTCACACAGTCCA |
| Guide_Cas13bC-luc_84_ADAR1Top (SEQ ID No. 255) | GACCATCCTGCGGCCTCTACTCTGCATTCAATTACATACTGACACATTCGGCAACATGTTTTTCCTGGTTTATTTTCACACAGTC |
| Guide_Cas13bC-luc_84_ADAR2Top (SEQ ID No. 256) | GAAACCATCCTGCGGCCTCTACTCTGCATTCAATTACATACTGACACATTCGGCAACATGTTTTTCCTGGTTTATTTTCACACAG |

-continued

| Sequence Name | Sequence |
|---|---|
| Guide_Cas13bC-luc_84_ADAR3Top (SEQ ID No. 257) | GCTAAACCATCCTGCGGCCTCTACTCTGCATTCAATTACATAC TGACACATTCGGCAACATGTTTTTCCTGGTTTATTTTCACAC |
| Guide_Cas13bC-luc_84_ADAR4Top (SEQ ID No. 258) | GTTCTAAACCATCCTGCGGCCTCTACTCTGCATTCAATTACAT ACTGACACATTCGGCAACATGTTTTTCCTGGTTTATTTTCAC |
| Guide_Cas13bC-luc_84_ADAR5Top (SEQ ID No. 259) | GTGTTCTAAACCATCCTGCGGCCTCTACTCTGCATTCAATTAC ATACTGACACATTCGGCAACATGTTTTTCCTGGTTTATTTTC |
| Guide_Cas13bC-luc_84_ADAR6Top (SEQ ID No. 260) | GAATGTTCTAAACCATCCTGCGGCCTCTACTCTGCATTCAATT ACATACTGACACATTCGGCAACATGTTTTTCCTGGTTTATTT |
| Guide_Cas13bC-luc_84_ADAR7Top (SEQ ID No. 261) | GAGAATGTTCTAAACCATCCTGCGGCCTCTACTCTGCATTCAA TTACATACTGACACATTCGGCAACATGTTTTTCCTGGTTTAT |
| Guide_Cas13bC-luc_84_ADAR8Top (SEQ ID No. 262) | GATAGAATGTTCTAAACCATCCTGCGGCCTCTACTCTGCATTC AATTACATACTGACACATTCGGCAACATGTTTTTCCTGGTTT |
| Guide_Cas13bC-luc_84_ADAR9Top (SEQ ID No. 263) | GCCATAGAATGTTCTAAACCATCCTGCGGCCTCTACTCTGCAT TCAATTACATACTGACACATTCGGCAACATGTTTTTCCTGGT |
| Guide_Cas13bC-luc_84_ADAR10Top (SEQ ID No. 264) | GTTCCATAGAATGTTCTAAACCATCCTGCGGCCTCTACTCTGC ATTCAATTACATACTGACACATTCGGCAACATGTTTTTCCTG |
| Guide_Cas13bC-luc_84_ADAR11Top (SEQ ID No. 265) | GCTTTCCATAGAATGTTCTAAACCATCCTGCGGCCTCTACTCT GCATTCAATTACATACTGACACATTCGGCAACATGTTTTTCC |
| Guide_Cas13bC-luc_84_ADAR12Top (SEQ ID No. 266) | GCTCTTTCCATAGAATGTTCTAAACCATCCTGCGGCCTCTACT CTGCATTCAATTACATACTGACACATTCGGCAACATGTTTTT |
| Guide_Cas13bC-luc_84_ADAR13Top (SEQ ID No. 267) | GATCTCTTTCCATAGAATGTTCTAAACCATCCTGCGGCCTCTA CTCTGCATTCAATTACATACTGACACATTCGGCAACATGTTT |
| Guide_Cas13bC-luc_84_ADAR14Top (SEQ ID No. 268) | GGAATCTCTTTCCATAGAATGTTCTAAACCATCCTGCGGCCTC TACTCTGCATTCAATTACATACTGACACATTCGGCAACATGT |
| Guide_Cas13bC-luc_84_ADAR15Top (SEQ ID No. 269) | GTGGAATCTCTTTCCATAGAATGTTCTAAACCATCCTGCGGCC TCTACTCTGCATTCAATTACATACTGACACATTCGGCAACAT |
| Guide_Cas13bC-luc_84_ADAR16Top (SEQ ID No. 270) | GACTGGAATCTCTTTCCATAGAATGTTCTAAACCATCCTGCGG CCTCTACTCTGCATTCAATTACATACTGACACATTCGGCAAC |
| Guide_Cas13bC-luc_84_ADAR17Top (SEQ ID No. 271) | GGAACTGGAATCTCTTTCCATAGAATGTTCTAAACCATCCTGC GGCCTCTACTCTGCATTCAATTACATACTGACACATTCGGCA |
| Guide_Cas13bC-luc_84_ADAR18Top (SEQ ID No. 272) | GTGGAACTGGAATCTCTTTCCATAGAATGTTCTAAACCATCCT GCGGCCTCTACTCTGCATTCAATTACATACTGACACATTCGG |
| Guide_Cas13bC-luc_84_ADAR19Top (SEQ ID No. 273) | GCCTGGAACTGGAATCTCTTTCCATAGAATGTTCTAAACCATC CTGCGGCCTCTACTCTGCATTCAATTACATACTGACACATTC |
| Guide_Cas13bC-luc_84_ADAR20Top (SEQ ID No. 274) | GTTCCTGGAACTGGAATCTCTTTCCATAGAATGTTCTAAACCA TCCTGCGGCCTCTACTCTGCATTCAATTACATACTGACACAT |
| Guide_Cas13bC-luc_84_ADAR21Top (SEQ ID No. 275) | GGGTTCCTGGAACTGGAATCTCTTTCCATAGAATGTTCTAAAC CATCCTGCGGCCTCTACTCTGCATTCAATTACATACTGACAC |

-continued

| Sequence Name | Sequence |
| --- | --- |
| Guide_Cas13bC-luc_84_ADAR22Top (SEQ ID No. 276) | GCAGGTTCCTGGAACTGGAATCTCTTTCCATAGAATGTTCTAAACCATCCTGCGGCCTCTACTCTGCATTCAATTACATACTGAC |
| Guide_Cas13bC-luc_84_ADAR23Top (SEQ ID No. 277) | GACCAGGTTCCTGGAACTGGAATCTCTTTCCATAGAATGTTCTAAACCATCCTGCGGCCTCTACTCTGCATTCAATTACATACTG |
| Guide_Cas13bC-luc_84_ADAR24Top (SEQ ID No. 278) | GGTACCAGGTTCCTGGAACTGGAATCTCTTTCCATAGAATGTTCTAAACCATCCTGCGGCCTCTACTCTGCATTCAATTACATAC |
| Guide_Cas13bC-luc_84_ADAR25Top (SEQ ID No. 279) | GATGTACCAGGTTCCTGGAACTGGAATCTCTTTCCATAGAATGTTCTAAACCATCCTGCGGCCTCTACTCTGCATTCAATTACAT |
| Guide_Cas13bC-luc_84_ADAR26Top (SEQ ID No. 280) | GGTATGTACCAGGTTCCTGGAACTGGAATCTCTTTCCATAGAATGTTCTAAACCATCCTGCGGCCTCTACTCTGCATTCAATTAC |
| Guide_Cas13bC-luc_84_ADAR27Top (SEQ ID No. 281) | GACGTATGTACCAGGTTCCTGGAACTGGAATCTCTTTCCATAGAATGTTCTAAACCATCCTGCGGCCTCTACTCTGCATTCAATT |
| Guide_Cas13bC-luc_84_ADAR28Top (SEQ ID No. 282) | GACACGTATGTACCAGGTTCCTGGAACTGGAATCTCTTTCCATAGAATGTTCTAAACCATCCTGCGGCCTCTACTCTGCATTCAA |
| Guide_Cas13bC-luc_84_ADAR29Top (SEQ ID No. 283) | GCAACACGTATGTACCAGGTTCCTGGAACTGGAATCTCTTTCCATAGAATGTTCTAAACCATCCTGCGGCCTCTACTCTGCATTC |
| Guide_Cas13bC-luc_84_ADAR30Top (SEQ ID No. 284) | GCCCAACACGTATGTACCAGGTTCCTGGAACTGGAATCTCTTTCCATAGAATGTTCTAAACCATCCTGCGGCCTCTACTCTGCAT |
| Guide_Cas13bC-luc_84_ADAR31Top (SEQ ID No. 285) | GGACCCAACACGTATGTACCAGGTTCCTGGAACTGGAATCTCTTTCCATAGAATGTTCTAAACCATCCTGCGGCCTCTACTCTGC |
| Guide_Cas13bC-luc_84_ADAR32Top (SEQ ID No. 286) | GTTGACCCAACACGTATGTACCAGGTTCCTGGAACTGGAATCTCTTTCCATAGAATGTTCTAAACCATCCTGCGGCCTCTACTCT |
| Guide_Cas13bC-luc_84_ADAR33Top (SEQ ID No. 287) | GCCTTGACCCAACACGTATGTACCAGGTTCCTGGAACTGGAATCTCTTTCCATAGAATGTTCTAAACCATCCTGCGGCCTCTACT |
| Guide_Cas13bC-luc_84_ADAR34Top (SEQ ID No. 288) | GTTCCTTGACCCAACACGTATGTACCAGGTTCCTGGAACTGGAATCTCTTTCCATAGAATGTTCTAAACCATCCTGCGGCCTCTA |
| Guide_Cas13bC-luc_84_ADAR35Top (SEQ ID No. 289) | GGGTTCCTTGACCCAACACGTATGTACCAGGTTCCTGGAACTGGAATCTCTTTCCATAGAATGTTCTAAACCATCCTGCGGCCTC |
| Guide_Cas13bC-luc_84_ADAR36Top (SEQ ID No. 290) | GTTGGTTCCTTGACCCAACACGTATGTACCAGGTTCCTGGAACTGGAATCTCTTTCCATAGAATGTTCTAAACCATCCTGCGGCC |
| Guide_Cas13bC-luc_84_ADAR37Top (SEQ ID No. 291) | GCCTTGGTTCCTTGACCCAACACGTATGTACCAGGTTCCTGGAACTGGAATCTCTTTCCATAGAATGTTCTAAACCATCCTGCGG |
| Guide_Cas13bC-luc_84_ADAR38Top (SEQ ID No. 292) | GGCCCTTGGTTCCTTGACCCAACACGTATGTACCAGGTTCCTGGAACTGGAATCTCTTTCCATAGAATGTTCTAAACCATCCTGC |
| Guide_Cas13bC-luc_84_ADAR39Top (SEQ ID No. 293) | GCCGCCCTTGGTTCCTTGACCCAACACGTATGTACCAGGTTCCTGGAACTGGAATCTCTTTCCATAGAATGTTCTAAACCATCCT |
| Guide_Cas13bC-luc_84_ADAR40Top (SEQ ID No. 294) | GCGCCGCCCTTGGTTCCTTGACCCAACACGTATGTACCAGGTTCCTGGAACTGGAATCTCTTTCCATAGAATGTTCTAAACCATC |

| Sequence Name | Sequence |
|---|---|
| Guide_Cas13bC-luc_84_ADAR41Top (SEQ ID No. 295) | GGTCGCCGCCCTTGGTTCCTTGACCCAACACGTATGTACCAGG TTCCTGGAACTGGAATCTCTTTCCATAGAATGTTCTAAACCA |

Reversing Causal Disease Mutations

The three genes in the Table below are synthesised with the pathogenic G>A mutation that introduces a pre-termination stop site into the gene and integrate them into a non-human cell line. The ability of Cas13b12-ADAR2 to correct the transcripts by changing the stop codon UAG to UIG (UGG) and thus restore protein translation is tested.

| Protein length (aa) | Full length candidates | Gene | Disease |
|---|---|---|---|
| 498 | NM_004992.3(MECP2): c.311G > A (p.Trp104Ter) | MECP2 | Rett syndrome |
| 414 | NM_007375.3(TARDBP): c.943G > A (p.Ala315Thr) | TARDBP | Amyotrophic lateral sclerosis type 10 |
| 393 | NM_000546.5(TP53): c.273G > A (p.Trp91Ter) | TP53 | Li-Fraumeni syndrome\|Hereditary cancer-predisposing syndrome |

Forty-eight more pathogenic G>A mutations are shown in Table 5 below along with the accompanying disease. 200 bp fragments around these mutations are synthesised, rather than the entire gene, and cloned in front of a GFP. When the pre-termination site is restored, that will allow translation of the GFP and correction can be measured by fluorescence in high-throughput—in addition to RNA sequencing.

TABLE 5

| Candidate | Gene | Disease |
|---|---|---|
| 1 NM_004006.2(DMD): c.3747G > A (p.Trp1249Ter) | DMD | Duchenne muscular dystrophy |
| 2 M_000344.3(SMN1): c.305G > A (p.Trp102Ter) | SMN1 | Spinal muscular atrophy, type II\|Kugelberg-Welander disease |
| 3 NM_000492.3(CFTR): c.3846G > A (p.Trp1282Ter) | CFTR | Cystic fibrosis\|Hereditary pancreatitis\|not provided\|ataluren response - Efficacy |
| 4 NM_004562.2(PRKN): c.1358G > A (p.Trp453Ter) | PRKN | Parkinson disease 2 |
| 5 NM_017651.4(AHI1): c.2174G > A (p.Trp725Ter) | AHI1 | Joubert syndrome 3 |
| 6 NM_000238.3(KCNH2): c.3002G > A (p.Trp1001Ter) | KCNH2 | Long QT syndrome\|not provided |
| 7 NM_000136.2(FANCC): c.1517G > A (p.Trp506Ter) | FANCC\|C9orf3 | Fanconi anemia, complementation group C |
| 8 NM_001009944.2(PKD1): c.12420G > A (p.Trp4140Ter) | PKD1 | Polycystic kidney disease, adult type |
| 9 NM_177965.3(C8orf37): c.555G > A (p.Trp185Ter) | C8orf37 | Retinitis pigmentosa 64 |
| 10 NM_000833.4(GRIN2A): c.3813G > A (p.Trp1271Ter) | GRIN2A | Epilepsy, focal, with speech disorder and with or without mental retardation |
| 11 NM_000548.4(TSC2): c.2108G > A (p.Trp703Ter) | TSC2 | Tuberous sclerosis 2\|Tuberous sclerosis syndrome |
| 12 NM_000267.3(NF1): c.7044G > A (p.Trp2348Ter) | NF1 | Neurofibromatosis, type 1 |
| 13 NM_000520.5(HEXA): c.1454G > A (p.Trp485Ter) | HEXA | Tay-Sachs disease |

TABLE 5-continued

| Candidate | Gene | Disease |
|---|---|---|
| 14 NM_130838.1(UBE3A): c.2304G > A (p.Trp768Ter) | UBE3A | Angelman syndrome |
| 15 NM_000543.4(SMPD1): c.168G > A (p.Trp56Ter) | SMPD1 | Niemann-Pick disease, type A |
| 16 NM_000218.2(KCNQ1): c.1175G > A (p.Trp392Ter) | KCNQ1 | Long QT syndrome |
| 17 NM_000256.3(MYBPC3): c.3293G > A (p.Trp1098Ter) | MYBPC3 | Primary familial hypertrophic cardiomyopathy |
| 18 (NM_000038.5(APC): c.1262G > A (p.Trp421Ter) | APC | Familial adenomatous polyposis 1 |
| 19 NM_000249.3(MLH1): c.1998G > A (p.Trp666Ter) | MLH1 | Lynch syndrome |
| 20 NM_000054.4(AVPR2): c.878G > A (p.Trp293Ter) | AVPR2 | Nephrogenic diabetes insipidus, X-linked |
| 21 NM_001204.6(BMPR2): c.893G > A (p.W298*) | BMPR2 | Primary pulmonary hypertension |
| 22 NM_004560.3(ROR2): c.2247G > A (p.Trp749Ter) | ROR2 | Brachydactyly type B1 |
| 23 NM_000518.4(HBB): c.114G > A (p.Trp38Ter) | HBB | beta^0^ Thalassemia\|beta Thalassemia |
| 24 NM_024577.3(SH3TC2): c.920G > A (p.Trp307Ter) | SH3TC2 | Charcot-Marie-Tooth disease, type 4C |
| 25 NM_206933.2(USH2A): c.9390G > A (p.Trp3130Ter) | USH2A | Usher syndrome, type 2A |
| 26 NM_000179.2(MSH6): c.3020G > A (p.Trp1007Ter) | MSH6 | Lynch syndrome |
| 27 NM_002977.3(SCN9A): c.2691G > A (p.Trp897Ter) | SCN9A\|LOC101929680 | Indifference to pain, congenital, autosomal recessive |
| 28 NM_000090.3(COL3A1): c.30G > A (p.Trp10Ter) | COL3A1 | Ehlers-Danlos syndrome, type 4 |
| 29 NM_000551.3(VHL): c.263G > A (p.Trp88Ter) | VHL | Von Hippel-Lindau syndrome\|not provided |
| 30 NM_015627.2(LDLRAP1): c.65G > A (p.Trp22Ter) | LDLRAP1 | Hypercholesterolemia, autosomal recessive |
| 31 NM_000132.3(F8): c.3144G > A (p.Trp1048Ter) | F8 | Hereditary factor VIII deficiency disease |
| 32 NM_002185.4(IL7R): c.651G > A (p.Trp217Ter) | IL7R | Severe combined immunodeficiency, autosomal recessive, T cell-negative, B cell-positive, NK cell-positive |
| 33 NM_000527.4(LDLR): c.1449G > A (p.Trp483Ter) | LDLR | Familial hypercholesterolemia |
| 34 NM_002294.2(LAMP2): c.962G > A (p.Trp321Ter) | LAMP2 | Danon disease |
| 35 NM_000271.4(NPC1): c.1142G > A (p.Trp381Ter) | NPC1 | Niemann-Pick disease type C1 |
| 36 NM_000267.3(NF1): c.1713 G > A (p.Trp571Ter) | NF1 | Neurofibromatosis, type 1 |
| 37 NM_000035.3(ALDOB): c.888G > A (p.Trp296Ter) | ALDOB | Hereditary fructosuria |
| 38 NM_000090.3(COL3A1): c.3833G > A (p.Trp1278Ter) | COL3A1 | Ehlers-Danlos syndrome, type 4 |
| 39 NM_001369.2(DNAH5): c.8465G > A (p.Trp2822Ter) | DNAH5 | Primary ciliary dyskinesia |
| 40 NM_178443.2(FERMT3): c.48G > A (p.Trp16Ter) | FERMT3 | Leukocyte adhesion deficiency, type III |
| 41 NM_005359.5(SMAD4): c.906G > A (p.Trp302Ter) | SMAD4 | Juvenile polyposis syndrome |
| 42 NM_032119.3(ADGRV1): c.7406G > A (p.Trp2469Ter) | ADGRV1 | Usher syndrome, type 2C |
| 43 NM_000206.2(IL2RG): c.710G > A (p.Trp237Ter) | IL2RG | X-linked severe combined immunodeficiency |
| 44 NM_007294.3(BRCA1): c.5511G > A (p.Trp1837Ter) | BRCA1 | Familial cancer of breast\|Breast-ovarian cancer, familial 1 |
| 45 NM_130799.2(MEN1): c.1269G > A (p.Trp423Ter) | MEN1 | Hereditary cancer-predisposing syndrome |
| 46 NM_000071.2(CBS): c.162G > A (p.Trp54Ter) | CBS | Homocystinuria due to CBS deficiency |
| 47 NM_000059.3(BRCA2): c.582G > A (p.Trp194Ter) | BRCA2 | Familial cancer of breast\|Breast-ovarian cancer, familial 2 |
| 48 NM_000053.3(ATP7B): c.2336G > A (p.Trp779Ter) | ATP7B | Wilson disease |

Example 3

Efficient and precise nucleic acid editing holds great promise for treating genetic disease, particularly at the level of RNA, where disease-relevant transcripts can be rescued to yield functional protein products. Type VI CRISPR-Cas systems contain the programmable single-effector RNA-guided RNases Cas13. Here, we profile the diversity of Type VI systems to engineer a Cas13 ortholog capable of robust knockdown and demonstrate RNA editing by using catalytically-inactive Cas13 (dCas13) to direct adenosine deaminase activity to transcripts in mammalian cells. By fusing the ADAR2 deaminase domain to dCas13 and engineering guide RNAs to create an optimal RNA duplex substrate, we achieve targeted editing of specific single adenosines to inosines (which is read out as guanosine during translation) with efficiencies routinely ranging from 20-40% and up to 89%. This system, referred to as RNA Editing for Programmable A to I Replacement (REPAIR), can be further engineered to achieve high specificity. An engineered variant, REPAIRv2, displays greater than 170-fold increase in specificity while maintaining robust on-target A to I editing. We use REPAIRv2 to edit full-length transcripts containing known pathogenic mutations and create functional truncated versions suitable for packaging in adeno-associated viral (AAV) vectors. REPAIR presents a promising RNA editing platform with broad applicability for research, therapeutics, and biotechnology. Precise nucleic acid editing technologies are valuable for studying cellular function and as novel therapeutics. Although current editing tools, such as the Cas9 nuclease, can achieve programmable modification of genomic loci, edits are often heterogenous due to insertions or deletions or require a donor template for precise editing. Base editors, such as dCas9-APOBEC fusions, allow for editing without generating a double stranded break, but may lack precision due to the nature of cytidine deaminase activity, which edits any cytidine in a target window. Furthermore, the requirement for a protospacer adjacent motif (PAM) limits the number of possible editing sites. Here, we describe the development of a precise and flexible RNA base editing tool using the RNA-guided RNA targeting Cas13 enzyme from type VI prokaryotic clustered regularly interspaced short palindromic repeats (CRISPR) adaptive immune system.

Precise nucleic acid editing technologies are valuable for studying cellular function and as novel therapeutics. Current editing tools, based on programmable nucleases such as the prokaryotic clustered regularly interspaced short palindromic repeats (CRISPR)-associated nucleases Cas9 (1-4) or Cpf1(5), have been widely adopted for mediating targeted DNA cleavage which in turn drives targeted gene disruption through non-homologous end joining (NHEJ) or precise gene editing through template-dependent homology-directed repair (HDR)(6). NHEJ utilizes host machineries that are active in both dividing and post-mitotic cells and provides efficient gene disruption by generating a mixture of insertion or deletion (indel) mutations that can lead to frame shifts in protein coding genes. HDR, in contrast, is mediated by host machineries whose expression is largely limited to replicating cells. As such, the development of gene-editing capabilities in post-mitotic cells remains a major challenge. Recently, DNA base editors, such as the use of catalytically inactive Cas9 (dCas9) to target cytidine deaminase activity to specific genome targets to effect cytosine to thymine conversions within a target window, allow for editing without generating a DNA double strand break and significantly reduces the formation of indels(7, 8). However the targeting range of DNA base editors is limited due to the requirement of Cas9 for a protospacer adjacent motif (PAM) at the editing site(9). Here, we describe the development of a precise and flexible RNA base editing technology using the type VI CRISPR-associated RNA-guided RNase Cas13(10-13).

Cas13 enzymes have two Higher Eukaryotes and Prokaryotes Nucleotide-binding (HEPN) endoRNase domains that mediate precise RNA cleavage(10, 11). Three Cas13 protein families have been identified to date: Cas13a (previously known as C2c2), Cas13b, and Cas13c(12, 13). We recently reported Cas13a enzymes can be adapted as tools for nucleic acid detection(14) as well as mammalian and plant cell RNA knockdown and transcript tracking(15). The RNA-guided nature of Cas13 enzymes makes them attractive tool for RNA binding and perturbation applications.

The adenosine deaminase acting on RNA (ADAR) family of enzymes mediates endogenous editing of transcripts via hydrolytic deamination of adenosine to inosine, a nucleobase that is functionally equivalent to guanosine in translation and splicing(16). There are two functional human ADAR orthologs, ADAR1 and ADAR2, which consist of N-terminal double stranded RNA-binding domains and a C-terminal catalytic deamination domain. Endogenous target sites of ADAR1 and ADAR2 contain substantial double stranded identity, and the catalytic domains require duplexed regions for efficient editing in vitro and in vivo(17, 18). Although ADAR proteins have preferred motifs for editing that could restrict the potential flexibility of targeting, hyperactive mutants, such as ADAR(E488Q)(19), relax sequence constraints and improve adenosine to inosine editing rates. ADARs preferentially deaminate adenosines opposite cytidine bases in RNA duplexes(20), providing a promising opportunity for precise base editing. Although previous approaches have engineered targeted ADAR fusions via RNA guides (21-24), the specificity of these approaches has not been reported and their respective targeting mechanisms rely on RNA-RNA hybridization without the assistance of protein partners that may enhance target recognition and stringency.

Here we assay the entire family of Cas13 enzymes for RNA knockdown activity in mammalian cells and identify the Cas13b ortholog from *Prevotella* sp. P5-125 (PspCas13b) as the most efficient and specific for mammalian cell applications. We then fuse the ADAR2 deaminase domain (ADARDD) to catalytically inactive PspCas13b and demonstrate RNA editing for programmable A to I (G) replacement (REPAIR) of reporter and endogenous transcripts as well as disease-relevant mutations. Lastly, we employ a rational mutagenesis scheme to improve the specificity of dCas13b-ADAR2DD fusions to generate REPAIRv2 with more than 170 fold increase in specificity.

Methods Design and Cloning of Bacterial Constructs

Mammalian codon optimized Cas13b constructs were cloned into the chloramphenicol resistant pACYC184 vector under control of the Lac promoter. Two corresponding direct-repeat (DR) sequences separated by BsaI restriction sites were then inserted downstream of Cas13b, under control of the pJ23119 promoter. Last, oligos for targeting spacers were phosphorylated using T4 PNK (New England Biolabs), annealed and ligated into BsaI digested vectors using T7 ligase (Enzymatics) to generate targeting Cas13b vectors.

Bacterial PFS Screens

Ampicillin resistance plasmids for PFS screens were cloned by inserting PCR products containing Cas13b targets with 2 5' randomized nucleotides and 4 3' randomized nucleotides separated by a target site immediately downstream of the start codon of the ampicillin resistance gene bla using NEB Gibson Assembly (New England Biolabs). 100 ng of ampicillin-resistant target plasmids were then electroporated with 65-100 ng chloramphenicol-resistant Cas13b bacterial targeting plasmids into Endura Electrocompetent Cells. Plasmids were added to cells, incubated 15 minutes on ice, electroporated using the manufacturer's protocol, and then 950 µL of recovery media was added to cells before a one hour outgrowth at 37 C. The outgrowth was plated onto chloramphenicol and ampicillin double selection plates. Serial dilutions of the outgrowth were used to estimate the cfu/ng DNA. 16 hours post plating, cells were scraped off plates and surviving plasmid DNA harvested using the Qiagen Plasmid Plus Maxi Kit (Qiagen). Surviving Cas13b target sequences and their flanking regions were amplified by PCR and sequenced using an Illumina NextSeq. To assess PFS preferences, the positions containing randomized nucleotides in the original library were extracted, and sequences depleted relative to the vector only condition that were present in both bioreplicates were extracted using custom python scripts. The –log 2 of the ratio of PFS abundance in the Cas13b condition compared to the vector only control was then used to calculate preferred motifs. Specifically, all sequences having –log 2(sample/vector) depletion ratios above a specific threshold were used to generate weblogos of sequence motifs (weblogo.berkeley.edu). The specific depletion ratio values used to generate weblogos for each Cas13b ortholog are listed in Table 9.

Design and Cloning of Mammalian Constructs for RNA Interference

To generate vectors for testing Cas13 orthologs in mammalian cells, mammalian codon optimized Cas13a, Cas13b, and Cas13c genes were PCR amplified and golden-gate cloned into a mammalian expression vector containing dual NLS sequences and a C-terminal msfGFP, under control of the EF1alpha promoter. For further optimization Cas13 orthologs were golden gate cloned into destination vectors containing different C-terminal localization tags under control of the EF1alpha promoter.

The dual luciferase reporter was cloned by PCR amplifying Gaussia and Cypridina luciferase coding DNA, the EF1alpha and CMV promoters and assembly using the NEB Gibson Assembly (New England Biolabs).

For expression of mammalian guide RNA for Cas13a, Cas13b, or Cas13c orthologs, the corresponding direct repeat sequences were synthesized with golden-gate acceptor sites and cloned under U6 expression via restriction digest cloning. Individual guides were then cloned into the corresponding expression backbones for each ortholog by golden gate cloning.

Cloning of Pooled Mismatch Libraries for Cas13 Interference Specificity

Pooled mismatch library target sites were created by PCR. Oligos containing semi-degenerate target sequences in G-luciferase containing a mixture of 94% of the correct base and 2% of each incorrect base at each position within the target were used as one primer, and an oligo corresponding to a non-targeted region of G-luciferase was used as the second primer in the PCR reaction. The mismatch library target was then cloned into the dual luciferase reporter in place of the wildtype G-luciferase using NEB Gibson assembly (New England Biolabs).

Design and Cloning of Mammalian Constructs for RNA Editing

PspCas13b was made catalytically inactive (dPspCas13b) via two histidine to alanine mutations (H133A/H1058A) at the catalytic site of the HEPN domains. The deaminase domains of human ADAR1 and ADAR2 were synthesized and PCR amplified for gibson cloning into pcDNA-CMV vector backbones and were fused to dPspCas13b at the C-terminus via GS or GSGGGGS (SEQ ID No. 296) linkers. For the experiment in which we tested different linkers we cloned the following additional linkers between dPspCas13b and ADAR2dd: GGGGSGGGGSGGGGS, EAAAK (SEQ ID No. 297), GGSGGSGGSGGSGGSGGS (SEQ ID No. 298), and SGSETPGTSESATPES (SEQ ID No. 299) (XTEN). Specificity mutants were generated by gibson cloning the appropriate mutants into the dPspCas13b-GSGGGGS backbone.

The luciferase reporter vector for measuring RNA editing activity was generated by creating a W85X mutation (TGG>TAG) in the luciferase reporter vector used for knockdown experiments. This reporter vector expresses functional Gluc as a normalization control, but a defective Cluc due to the addition of a pretermination site. To test ADAR editing motif preferences, we cloned every possible motif around the adenosine at codon 85 (XAX) of Cluc.

For testing PFS preference of REPAIR, we cloned a pooled plasmid library containing a 6 basepair degenerate PFS sequence upstream of a target region and adenosine editing site. The library was synthesized as an ultramer from Integrated DNA Technologies (IDT) and was made double stranded via annealing a primer and Klenow fragment of DNA polymerase I (New England Biolabs) fill in of the sequence. This dsDNA fragment containing the degenerate sequence was then gibson cloned into the digested reporter vector and this was then isopropanol precipitated and purified. The cloned library was then electroporated into Endura competent E. coli cells (Lucigen) and plated on 245 mm×245 mm square bioassay plates (Nunc). After 16 hours, colonies were harvested and midiprepped using endotoxinfree MACHEREY-NAGEL midiprep kits. Cloned libraries were verified by next generation sequencing.

For cloning disease-relevant mutations for testing REPAIR activity, 34 G>A mutations related to disease pathogenesis as defined in ClinVar were selected and 200 bp regions surrounding these mutations were golden gate cloned between mScarlet and EGFP under a CMV promoter. Two additional G>A mutations in AVPR2 and FANCC were selected for Gibson cloning the whole gene sequence under expression of EF1alpha.

For expression of mammalian guide RNA for REPAIR, the PspCas13b direct repeat sequences were synthesized with golden-gate acceptor sites and cloned under U6 expression via restriction digest cloning. Individual guides were then cloned into this expression backbones by golden gate cloning.

Mammalian Cell Culture

Mammalian cell culture experiments were performed in the HEK293FT line (American Type Culture Collection (ATCC)), which was grown in Dulbecco's Modified Eagle Medium with high glucose, sodium pyruvate, and GlutaMAX (Thermo Fisher Scientific), additionally supplemented with 1× penicillin-streptomycin (Thermo Fisher Scientific) and 10% fetal bovine serum (VWR Seradigm). Cells were maintained at confluency below 80%.

Unless otherwise noted, all transfections were performed with Lipofectamine 2000 (Thermo Fisher Scientific) in 96-well plates coated with poly-D-lysine (BD Biocoat). Cells were plated at approximately 20,000 cells/well sixteen hours prior to transfection to ensure 90% confluency at the time of transfection. For each well on the plate, transfection plasmids were combined with Opti-MEM I Reduced Serum Medium (Thermo Fisher) to a total of 25 µl. Separately, 24.5 ul of Opti-MEM was combined with 0.5 ul of Lipofectamine 2000. Plasmid and Lipofectamine solutions were then combined and incubated for 5 minutes, after which they were pipetted onto cells.

RNA Knockdown Mammalian Cell Assays

To assess RNA targeting in mammalian cells with reporter constructs, 150 ng of Cas13 construct was co-transfected with 300 ng of guide expression plasmid and 12.5 ng of the knockdown reporter construct. 48 hours post-transfection, media containing secreted luciferase was removed from cells, diluted 1:5 in PBS, and measured for activity with BioLux *Cypridina* and Biolux *Gaussia* luciferase assay kits (New England Biolabs) on a plate reader (Biotek Synergy Neo2) with an injection protocol. All replicates performed are biological replicates.

For targeting of endogenous genes, 150 ng of Cas13 construct was co-transfected with 300 ng of guide expression plasmid. 48 hours post-transfection, cells were lysed and RNA was harvested and reverse transcribed using a previously described [CITE PROTOCOLS] modification of the Cells-to-Ct kit (Thermo Fisher Scientific). cDNA expression was measured via qPCR using TaqMan qPCR probes for the KRAS transcript (Thermo Fisher Scientific), GAPDH control probes (Thermo Fisher Scientific), and Fast Advanced Master Mix (Thermo Fisher Scientific). qPCR reactions were read out on a LightCycler 480 Instrument II (Roche), with four 5 ul technical replicates in 384-well format.

Evaluation of RNA Specificity Using Pooled Library of Mismatched Targets

The ability of Cas13 to interfere with the mismatched target library was tested using HEK293FT cells seeded in 6 well plates. ~70% confluent cells were transfected using 2400 ng Cas13 vector, 4800 ng of guide and 240 ng of mismatched target library. 48 hours post transfection, cells were harvested and RNA extracted using the QIAshredder (Qiagen) and the Qiagen RNeasy Mini Kit. 1 ug of extracted RNA was reverse transcribed using the qScript Flex cDNA synthesis kit (Quantabio) following the manufacturer's gene-specific priming protocol and a Gluc specific RT primer. cDNA was then amplified and sequenced on an Illumina NextSeq.

The sequencing was analyzed by counting reads per sequence and depletion scores were calculated by determining the log 2(-read count ratio) value, where read count ratio is the ratio of read counts in the targeting guide condition versus the non-targeting guide condition. This score value represents the level of Cas13 activity on the sequence, with higher values representing stronger depletion and thus higher Cas13 cleavage activity. Separate distributions for the single mismatch and double mismatch sequences were determined and plotted as heatmaps with a depletion score for each mismatch identity. For double mismatch sequences the average of all possible double mismatches at a given position were plotted.

Transcriptome-Wide Profiling of Cas13 in Mammalian Cells by RNA Sequencing

For measurement of transcriptome-wide specificity, 150 ng of Cas13 construct, 300 ng of guide expression plasmid and 15 ng of the knockdown reporter construct were co-transfected; for shRNA conditions, 300 ng of shRNA targeting plasmid, 15 ng of the knockdown reporter construct, and 150 ng of EF1-alpha driven mCherry (to balance reporter load) were co-transfected. 48 hours after transfection, RNA was purified with the RNeasy Plus Mini kit (Qiagen), mRNA was selected for using NEBNext Poly(A) mRNA Magnetic Isolation Module (New England Biolabs) and prepared for sequencing with the NEBNext Ultra RNA Library Prep Kit for Illumina (New England Biolabs). RNA sequencing libraries were then sequenced on a NextSeq (Illumina).

To analyze transcriptome-wide sequencing data, reads were aligned RefSeq GRCh38 assembly using Bowtie and RSEM version 1.2.31 with default parameters [CITE RSEM: accurate transcript quantification from RNA-Seq data with or without a reference genome]. Transcript expression was quantified as log 2(TPM+1), genes were filtered for log 2(TPM+1) >2.5 For selection of differentially expressed genes, only genes with differential changes of >2 or <0.75 were considered. Statistical significance of differential expression was evaluated Student's T-test on three targeting replicates versus non-targeting replicates, and filtered for a false discovery rate of <0.01% by Benjamini-Hochberg procedure.

ADAR RNA Editing in Mammalian Cells Transfections

To assess REPAIR activity in mammalian cells, we transfected 150 ng of REPAIR vector, 300 ng of guide expression plasmid, and 40 ng of the RNA editing reporter. After 48 hours, RNA from cells were harvested and reverse transcribed using a method previously described [cite JJ] with a gene specific reverse transcription primer. The extracted cDNA was then subjected to two rounds of PCR to add Illumina adaptors and sample barcodes using NEBNext High-Fidelity 2×PCR Master Mix. The library was then subjected to next generation sequencing on an Illumina NextSeq or MiSeq. RNA editing rates were then evaluated at all adenosine within the sequencing window.

In experiments where the luciferase reporter was targeted for RNA editing, we also harvested the media with secreted luciferase prior to RNA harvest. In this case, because the corrected Cluc might be at low levels, we did not dilute the media. We measured luciferase activity with BioLux *Cypridina* and Biolux *Gaussia* luciferase assay kits (New England Biolabs) on a plate reader (Biotek Synergy Neo2) with an injection protocol. All replicates performed are biological replicates.

PFS Binding Mammalian Screen

To determine the contribution of the PFS to editing efficiency, 625 ng of PFS target library, 4.7 ug of guide, and 2.35 ug of REPAIR were co-transfected on HEK293FT cells plated in 225 cm2 flasks. Plasmids were mixed with 33 ul of PLUS reagent (Thermo Fisher Scientific), brought to 533 ul with Opti-MEM, incubated for 5 minutes, combined with 30 ul of Lipofectamine 2000 and 500 ul of Opti-MEM, incubated for an additional 5 minutes, and then pipetted onto cells. 48 hours post-transfection, RNA was harvested with the RNeasy Plus Mini kit (Qiagen), reverse transcribed with qScript Flex (Quantabio) using a gene specific primer, and amplified with two rounds of PCR using NEBNext High-Fidelity 2×PCR Master Mix (New England Biolabs) to add Illumina adaptors and sample barcodes. The library was sequenced on an Illumina NextSeq, and RNA editing rates at the target adenosine were mapped to PFS identity. To increase coverage, the PFS was computationally collapsed to 4 nucleotides. REPAIR editing rates were calculated for each PFS, averaged over biological replicates with non-targeting rates for the corresponding PFS subtracted.

Whole-Transcriptome Sequencing to Evaluate ADAR Editing Specificity

For analyzing off-target RNA editing sites across the transcriptome, we harvested total RNA from cells 48 hours post transfection using the RNeasy Plus Miniprep kit (Qiagen). The mRNA fraction is then enriched using a NEBNext Poly(A) mRNA Magnetic Isolation Module (NEB) and this RNA is then prepared for sequencing using NEBNext Ultra RNA Library Prep Kit for Illumina (NEB). The libraries were then sequenced on an Illumina NextSeq and loaded such that there was at least 5 million reads per sample.

RNA Editing Analysis for Targeted and Transcriptome Wide Experiments

To analyze the transcriptome-wide RNA editing RNA sequencing data, sequence files were randomly down-sampled to 5 million reads. An index was generated using the RefSeq GRCh38 assembly with Gluc and Cluc sequences added and reads were aligned and quantified using Bowtie/RSEM version 1.3.0. Alignment BAMs were then sorted and analyzed for RNA editing sites using REDitools [cite] with the following parameters: -t 8 -e -d -1 -U [AG or TC]-p -u -m20 -T6-0 -W -v 1 -n 0.0. Any significant edits found in untransfected or EGFP-transfected conditions were considered to be SNPs or artifacts of the transfection and filtered out from the analysis of off-targets. Off-targets were considered significant if the Fisher's exact test yielded a p-value less than 0.5 and that at least 2 of 3 biological replicates identified the edit site.

For analyzing the predicted variant effects of each off-target, the list of off-target edit sites was analyzed using the variant annotation integrator (genome.ucsc.edu/cgi-bin/hgVai) as part of the UCSC genome browser suite of tools using the SIFT and PolyPhen-2 annotations. To declare whether the off-target genes are oncogenic, a database of oncogenic annotations from the COSMIC catalogue of somatic mutations in cancer (cancer.sanger.ac.uk).

For analyzing whether the REPAIR constructs perturbed RNA levels, the transcript per million (TPM) values output from the RSEM analysis were used for expression counts and transformed to log-space by taking the log 2(TPM+1). To find differentially regulated genes, a Student's t-test was performed on three targeting guide replicates versus three non-targeting guide replicates. The statistical analysis was only performed on genes with log 2(TPM+1) values greater than 2.5 and genes were only considered differentially regulated if they had a fold change greater than 2 or less than 0.8. Genes were reported if they had a false discovery rate of less than 0.01.

Results

Comprehensive Characterization of Cas13 Family Members in Mammalian Cells

Figure 49A:
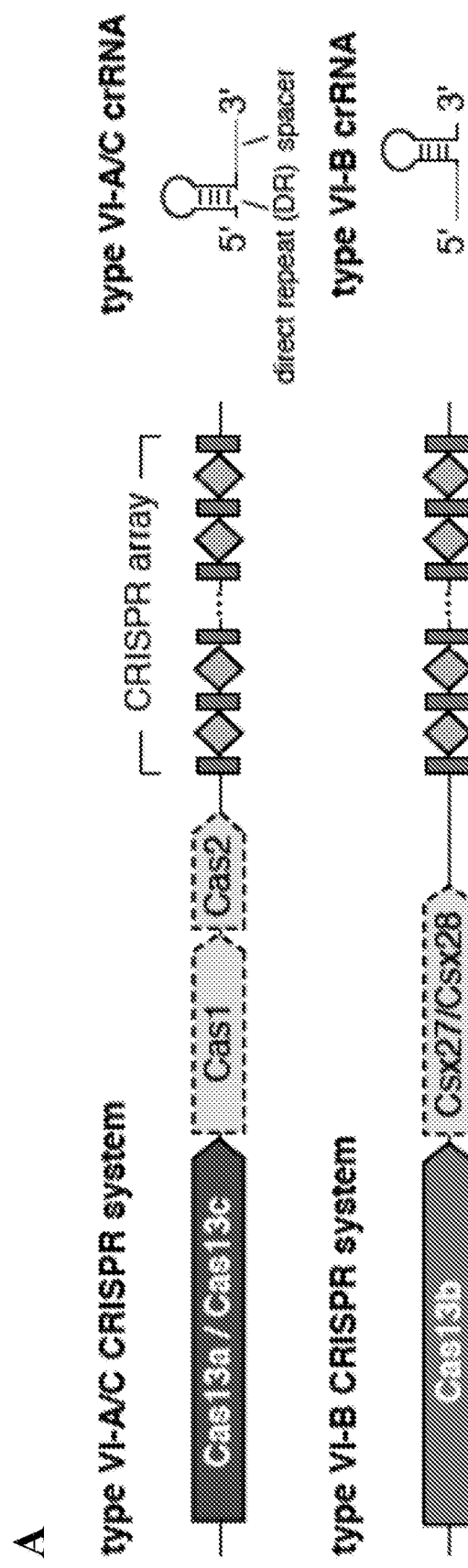
FIGS. 49A-49G: Characterization of a highly active Cas13b ortholog for RNA knockdown (FIG. 49A) Schematic of stereotypical Cas13 loci and corresponding crRNA structure.
Figure 55B:
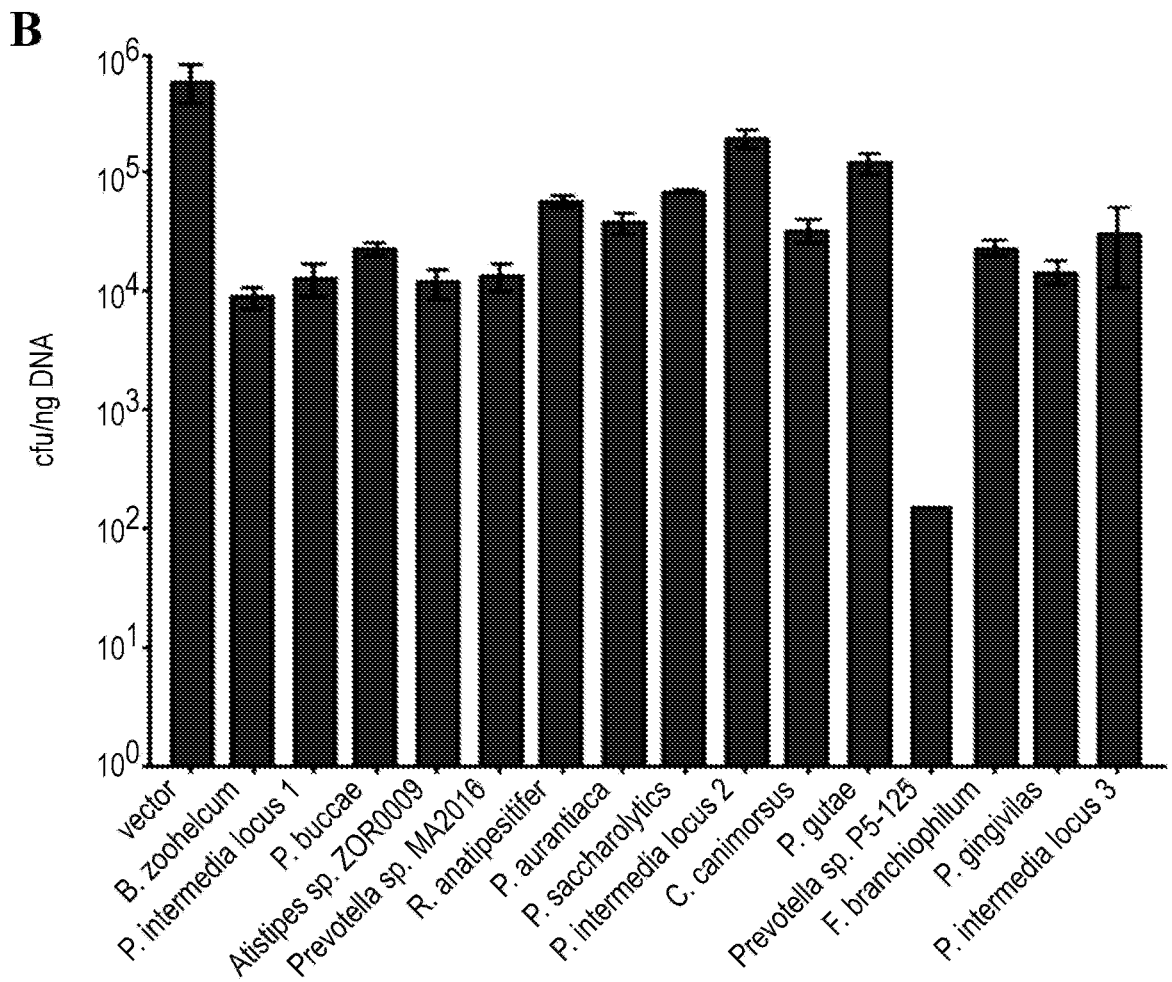
Figure 55C:
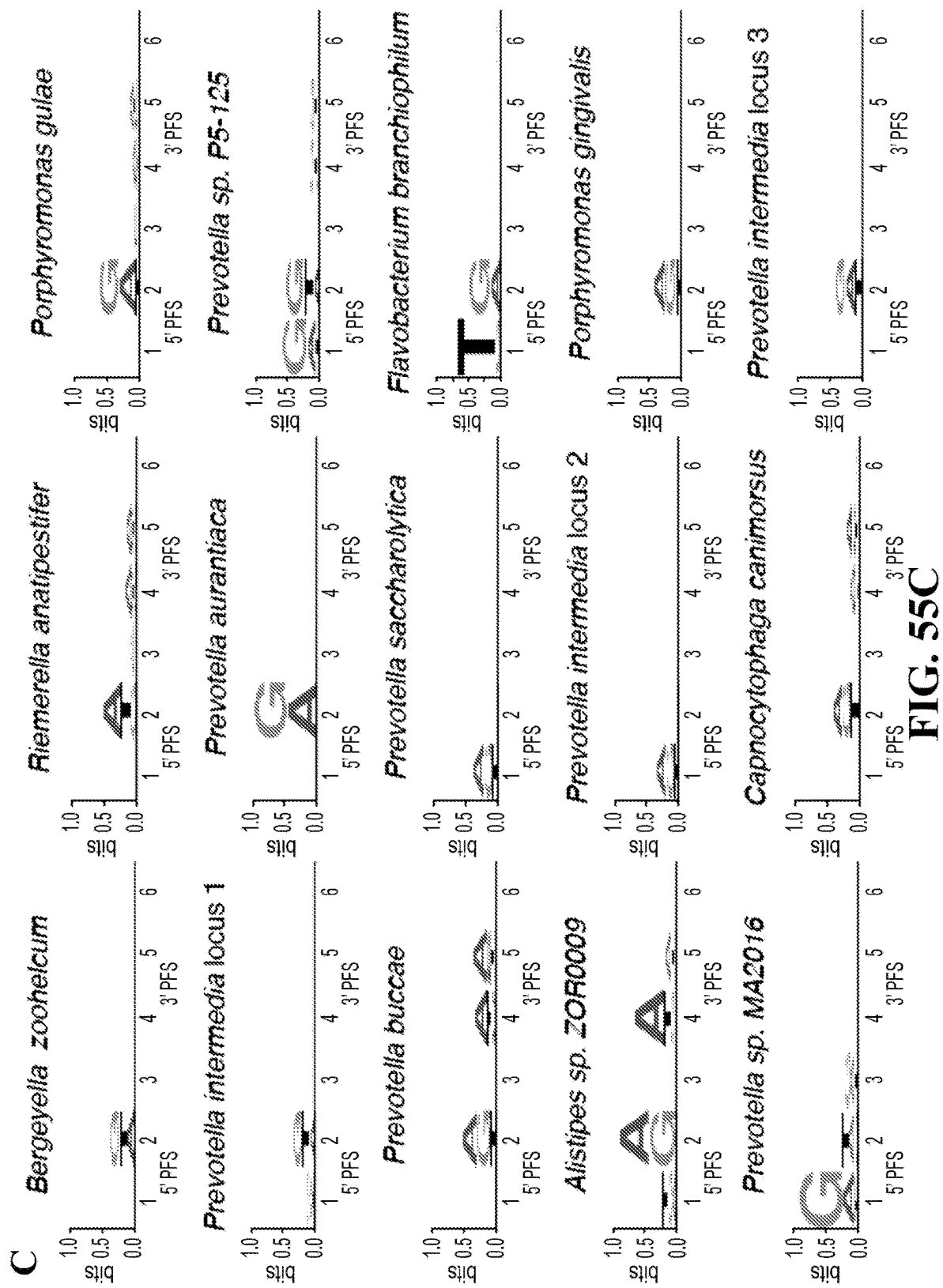

We previously developed LwaCas13a for mammalian knockdown applications, but it required an msfGFP stabilization domain for efficient knockdown and, although the specificity was high, knockdown efficiencies were not consistently below 50%(15). We sought to identify a more robust RNA-targeting CRISPR system by characterizing a genetically diverse set of Cas13 family members to assess their RNA knockdown activity in mammalian cells (FIG. 49A). We cloned 21 Cas13a, 15 Cas13b, and 7 Cas13c mammalian codon-optimized orthologs (Table 6) into an expression vector with N- and C-terminal nuclear export signal (NES) sequences and a C-terminal msfGFP to enhance protein stability. To assay interference in mammalian cells, we designed a dual reporter construct expressing the orthogonal *Gaussia* (Gluc) and *Cypridina* (Cluc) luciferases under separate promoters, which allows one luciferase to function as a measure of Cas13 interference activity and the other to serve as an internal control. For each ortholog, we designed PFS-compatible guide RNAs, using the Cas13b PFS motifs derived from an ampicillin interference assay (FIGS. 55A-55C; Table 7; Supplementary Note 1) and the 3' H PFS from previous reports of Cas13a activity(10).

Figure 49B:
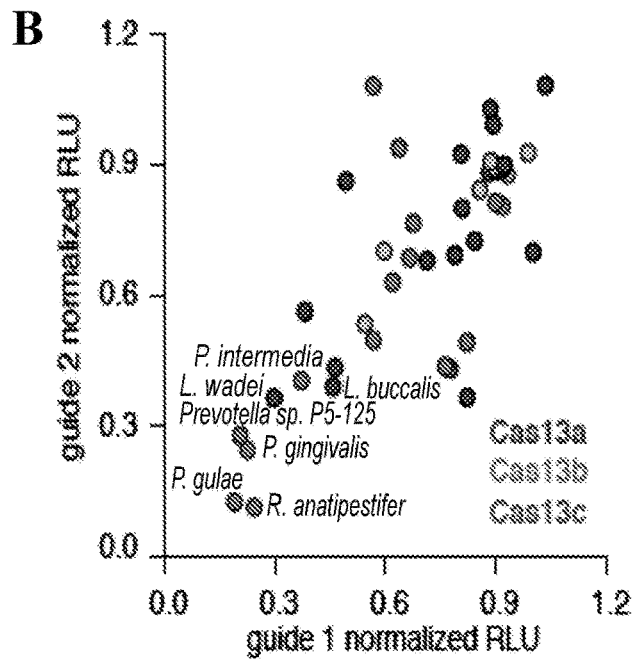

We transfected HEK293FT cells with Cas13 expression, guide RNA and reporter plasmids and quantified levels of the targeted Gluc 48 hours later. Testing two guide RNAs for each Cas13 ortholog revealed a range of activity levels, including five Cas13b orthologs with similar or increased interference across both guide RNAs relative to the recently characterized LwaCas13a (FIG. 49B). We selected these five Cas13b orthologs, as well as the top two Cas13a orthologs for further engineering.

Figure 56A:
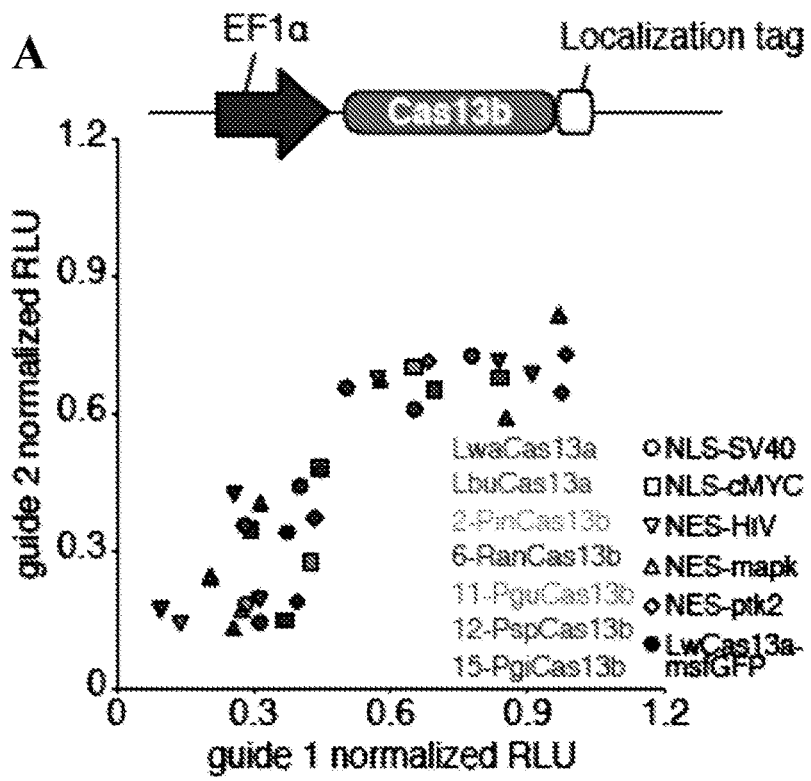
Figure 56B:
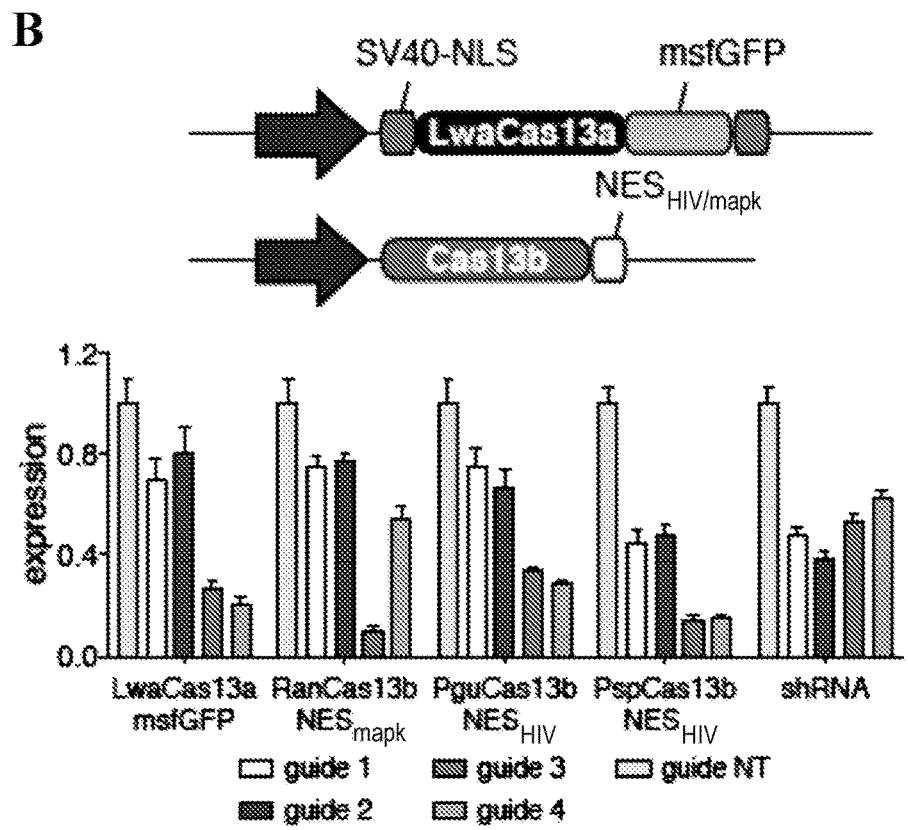

We next tested for Cas13-mediated knockdown of Gluc without msfGFP, in order to select orthologs that do not require stabilization domains for robust activity. We hypothesized that, in addition to msfGFP, Cas13 activity could be affected by subcellular localization, as previously reported for optimization of LwaCas13a(15). Therefore, we tested the interference activity of the seven selected Cas13 orthologs C-terminally fused to one of six different localization tags without msfGFP. Using the luciferase reporter assay, we found that PspCas13b and PguCas13b C-terminally fused to the HIV Rev gene NES and RanCas13b C-terminally fused to the MAPK NES had the highest levels of interference activity (FIG. 56A). To further distinguish activity levels of the top orthologs, we compared the three optimized Cas13b constructs to the optimal LwaCas13a-msfGFP fusion and shRNA for their ability to knockdown the KRAS transcript using position-matched guides (FIG. 56B). We observed the highest levels interference for PspCas13b (average knockdown 62.9%) and thus selected this for further comparison to LwaCas13a.

Figure 49C:
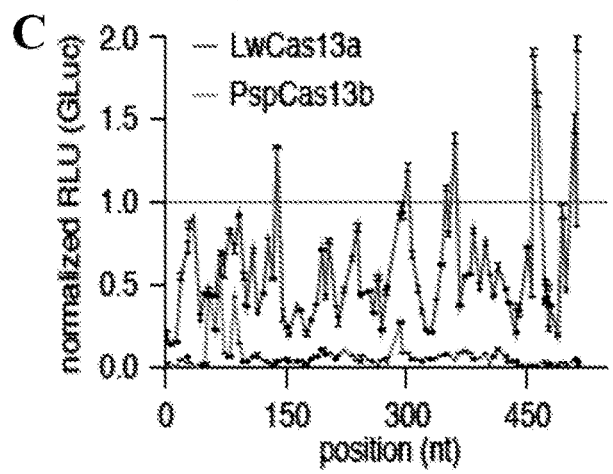
Figure 49D:
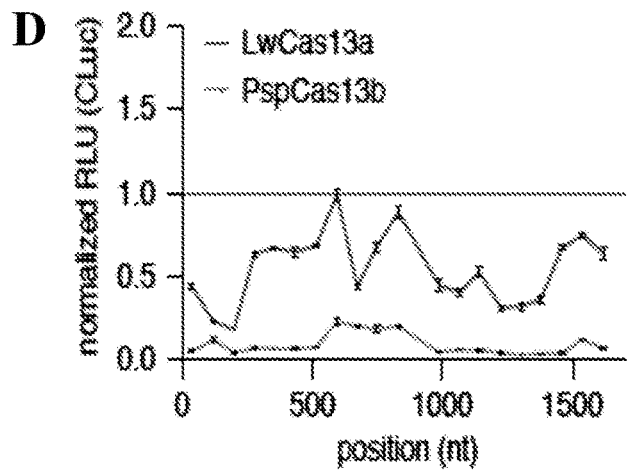

To more rigorously define the activity level of PspCas13b and LwaCas13a we designed position matched guides tiling along both Gluc and Cluc and assayed their activity using our luciferase reporter assay. We tested 93 and 20 position matched guides targeting Glue and Cluc, respectively, and found that PspCas13b had consistently increased levels of knockdown relative to LwaCas13a (average of 92.3% for PspCas13b vs. 40.1% knockdown for LwaCas13a) (FIGS. 49C, 49D).

Specificity of Cas13 Mammalian Interference Activity

Figure 56D:
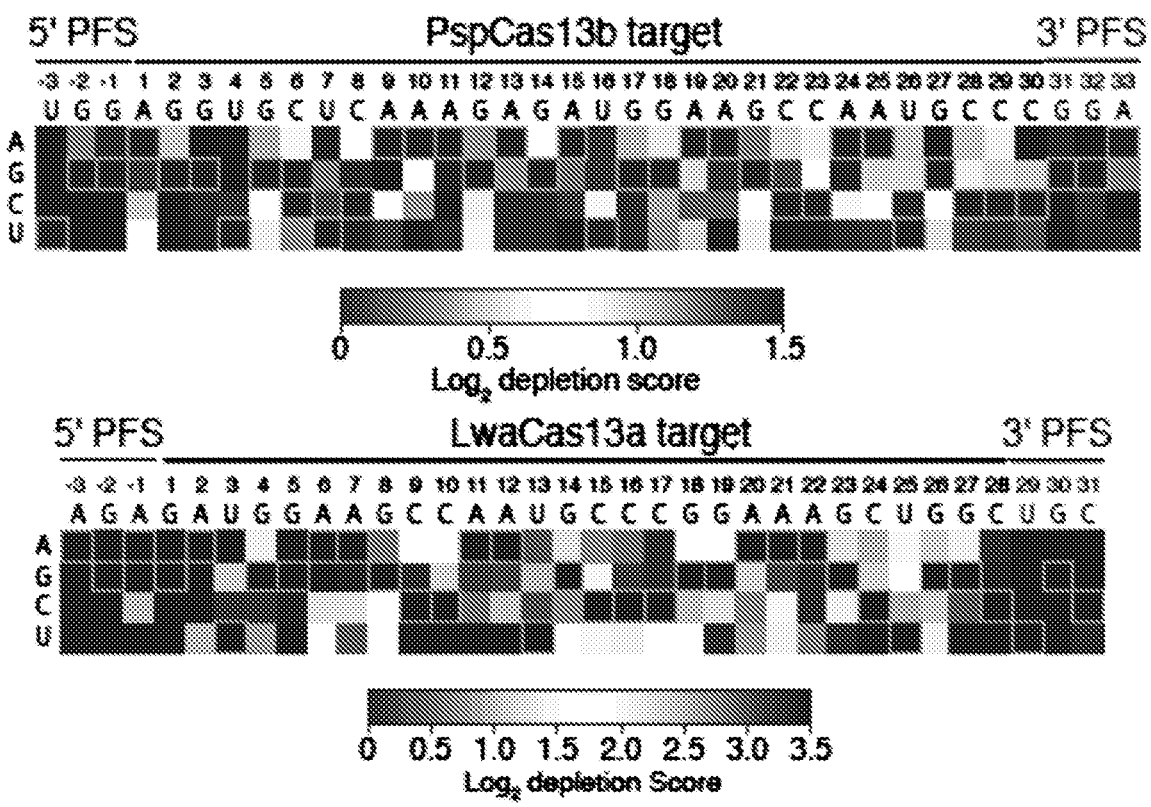

To characterize the interference specificities of PspCas13b and LwaCas13a we designed a plasmid library of luciferase targets containing single mismatches and double mismatches throughout the target sequence and the three flanking 5' and 3' base pairs (FIG. 56C). We transfected HEK293FT cells with either LwaCas13a or PspCas13b, a fixed guide RNA targeting the unmodified target sequence, and the mismatched target library corresponding to the appropriate system. We then performed targeted RNA sequencing of uncleaved transcripts to quantify depletion of mismatched target sequences. We found that LwaCas13a and PspCas13b had a central region that was relatively intolerant to single mismatches, extending from base pairs 12-26 for the PspCas13b target and 13-24 for the LwaCas13a target (FIG. 56D). Double mismatches were even less tolerated than single mutations, with little knockdown activity observed over a larger window, extending from base pairs 12-29 for PspCas13b and 8-27 for LwaCas13a in their respective targets (FIG. 56E). Additionally, because there are mismatches included in the three nucleotides flanking the 5' and 3' ends of the target sequence, we could assess PFS constraints on Cas13 knockdown activity. Sequencing showed that almost all PFS combinations allowed robust knockdown, indicating that a PFS constraint for interference in mammalian cells likely does not exist for either enzyme tested. These results indicate that Cas13a and Cas13b display similar sequence constraints and sensitivities against mismatches.

We next characterized the interference specificity of PspCas13b and LwaCas13a across the mRNA fraction of the transcriptome. We performed transcriptome-wide mRNA sequencing to detect significant differentially expressed genes. LwaCas13a and PspCas13b demonstrated robust knockdown of Gluc (FIGS. 49E, 49F) and were highly specific compared to a position-matched shRNA, which showed hundreds of off-targets (FIG. 49G).

Cas13-ADAR Fusions Enable Targeted RNA Editing

Figure 50A:
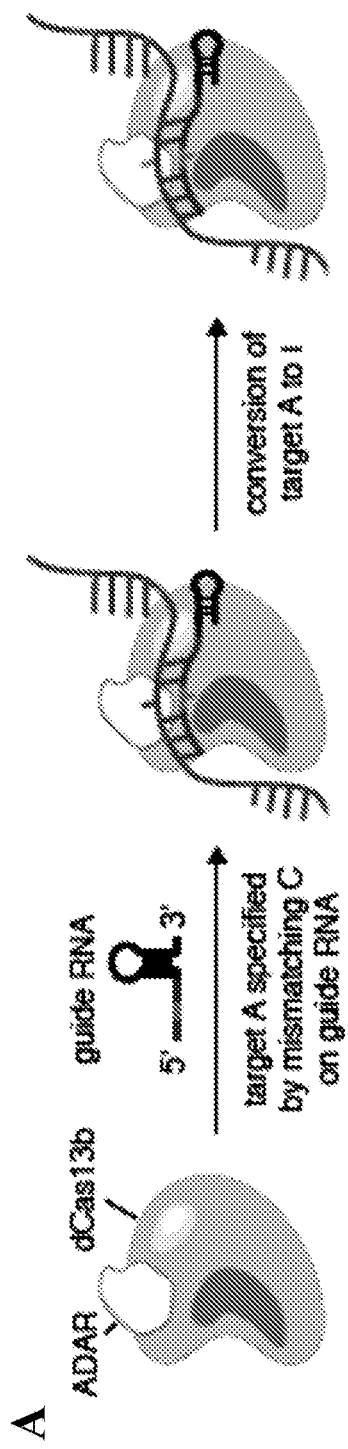
FIGS. 50A-50E: Engineering dCas13b-ADAR fusions for RNA editing (FIG. 50A) Schematic of RNA editing by dCas13b-ADAR fusion proteins.
Figure 57A:
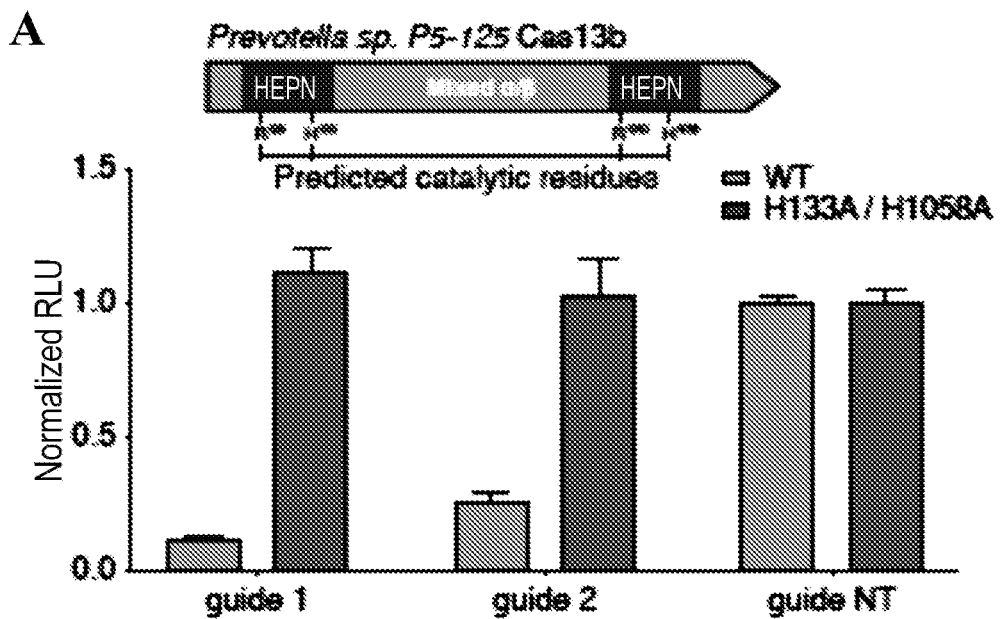
FIGS. 57A-57F: Characterization of design parameters for dCas13-ADAR2 RNA editing (FIG. 57A) Knockdown efficiency of Gluc targeting for wildtype Cas13b and catalytically inactive H133A/H1058A Cas13b (dCas13b).

Given that PspCas13b achieved consistent, robust, and specific knockdown of mRNA in mammalian cells, we envisioned that it could be adapted as an RNA binding platform to recruit the deaminase domain of ADARs ($ADAR_{DD}$) for programmable RNA editing. To engineer a PspCas13b lacking nuclease activity (dPspCas13b, referred to as dCas13b from here), we mutated conserved catalytic residues in the HEPN domains and observed loss of luciferase RNA knockdown activity (FIG. 57A). We hypothesized that a dCas13b-$ADAR_{DD}$ fusion could be recruited by a guide RNA to target adenosines, with the hybridized RNA creating the required duplex substrate for ADAR activity (FIG. 50A). To enhance target adenosine deamination rates we introduced two additional modifications to our initial RNA editing design: we introduced a mismatched cytidine opposite the target adenosine, which has been previously reported to increase deamination frequency, and fused dCas13b with the deaminase domains of human ADAR1 or ADAR2 containing hyperactivating mutations to enhance catalytic activity ($ADAR1_{DD}$(E1008Q)(25) or $ADAR2_{DD}$(E488Q)(19)).

Figure 50B:
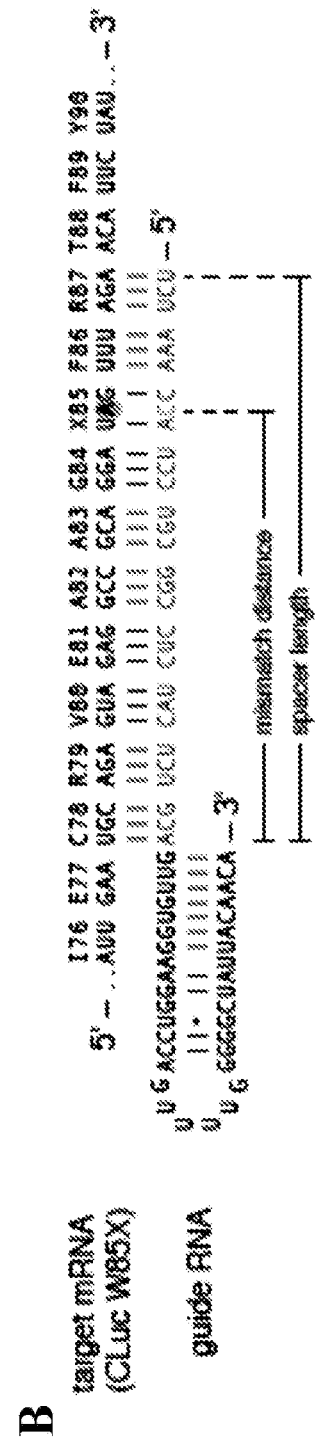
Figure 50C:
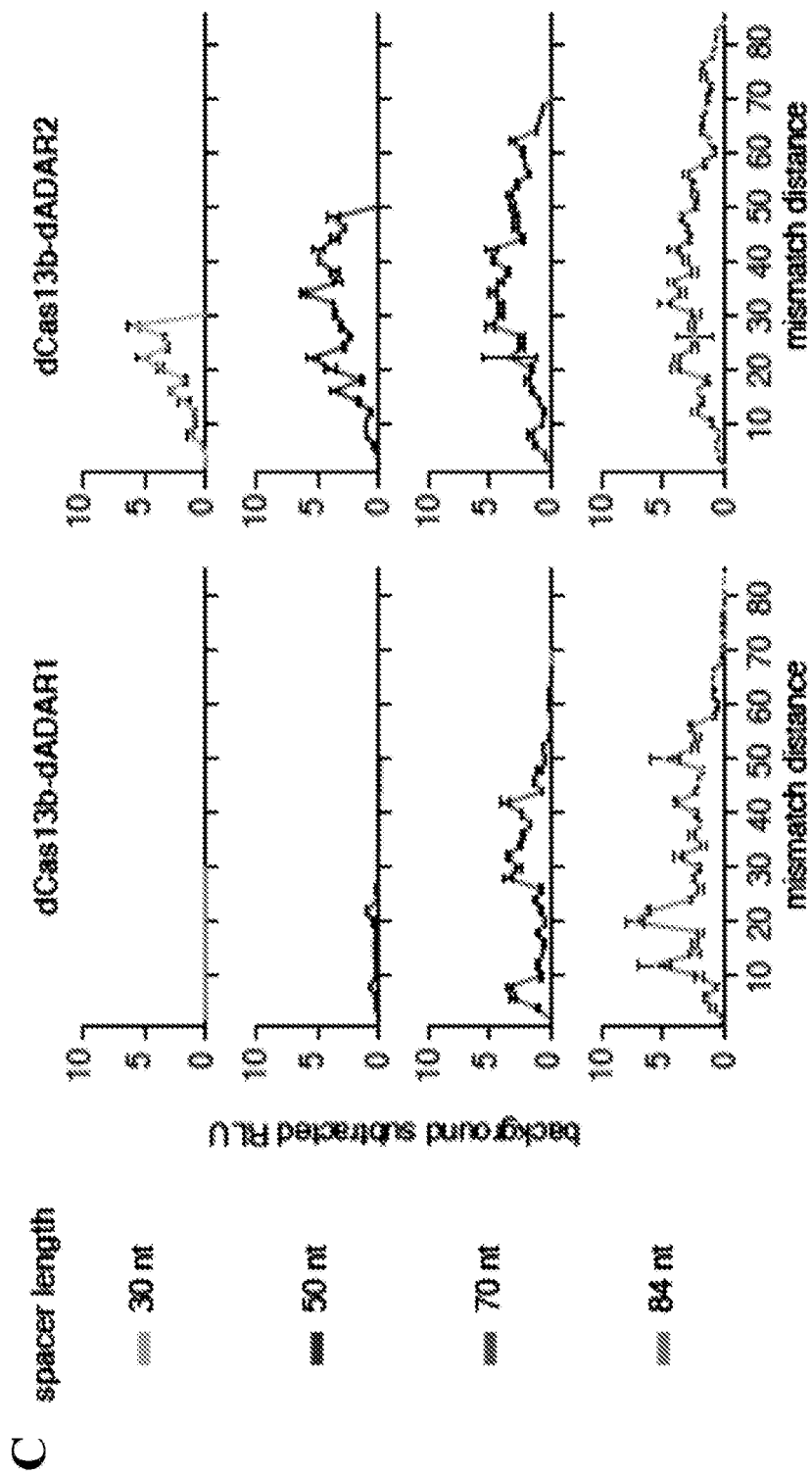
Figure 57B:
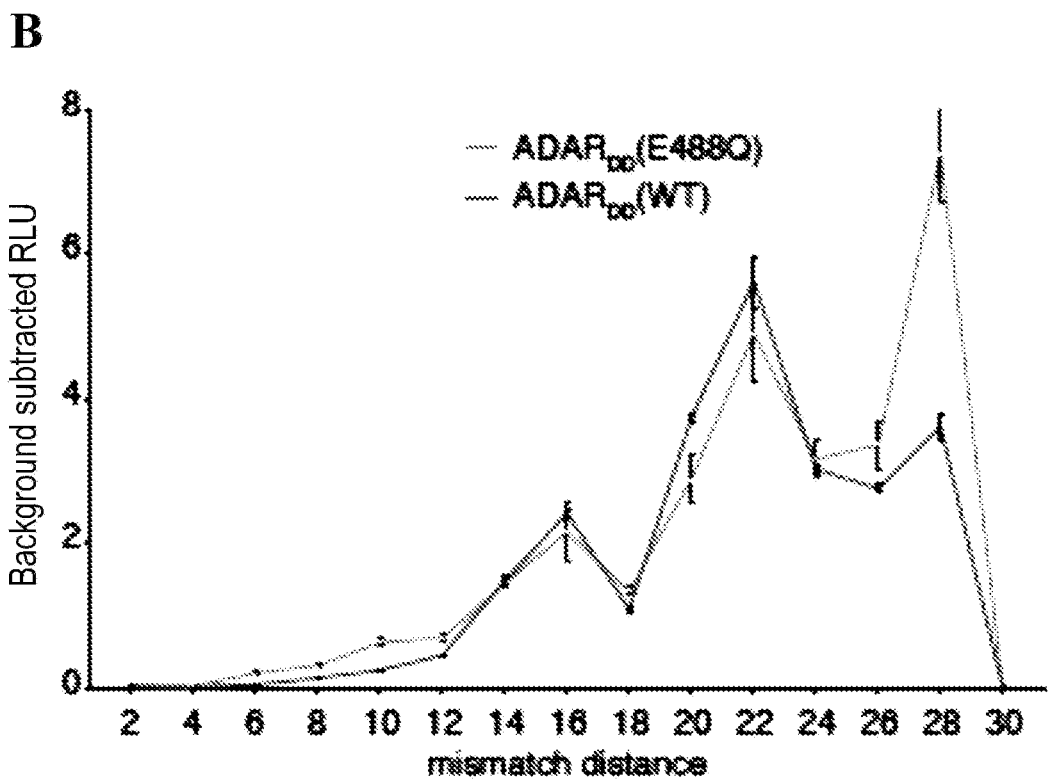

To test the activity of dCas13b-$ADAR_{DD}$ we generated an RNA-editing reporter on Cluc by introducing a nonsense mutation (W85x (UGG→UAG)), which could functionally be repaired to the wildtype codon through A→I editing (FIG. 50B) and then be detected as restoration of Cluc luminescence. We evenly tiled guides with spacers 30, 50, 70 or 84 nucleotides in length across the target adenosine to determine the optimal guide placement and design (FIG. 50C). We found that dCas13b-$ADAR1_{DD}$ required longer guides to repair the Cluc reporter, while dCas13b-$ADAR2_{DD}$ was functional with all guide lengths tested (FIG. 50C). We also found that the hyperactive E488Q mutation improved editing efficiency, as luciferase restoration with the wildtype $ADAR2_{DD}$ was reduced (FIG. 57B). From this demonstration of activity, we chose dCas13b-$ADAR2_{DD}$(E488Q) for further characterization and designated this approach as RNA Editing for Programmable A to I Replacement version 1 (REPAIRv1).

Figure 50D:
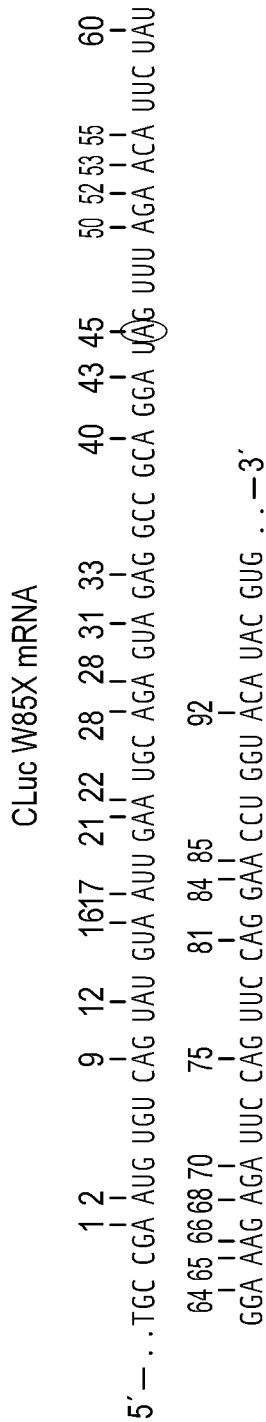
Figure 50E:
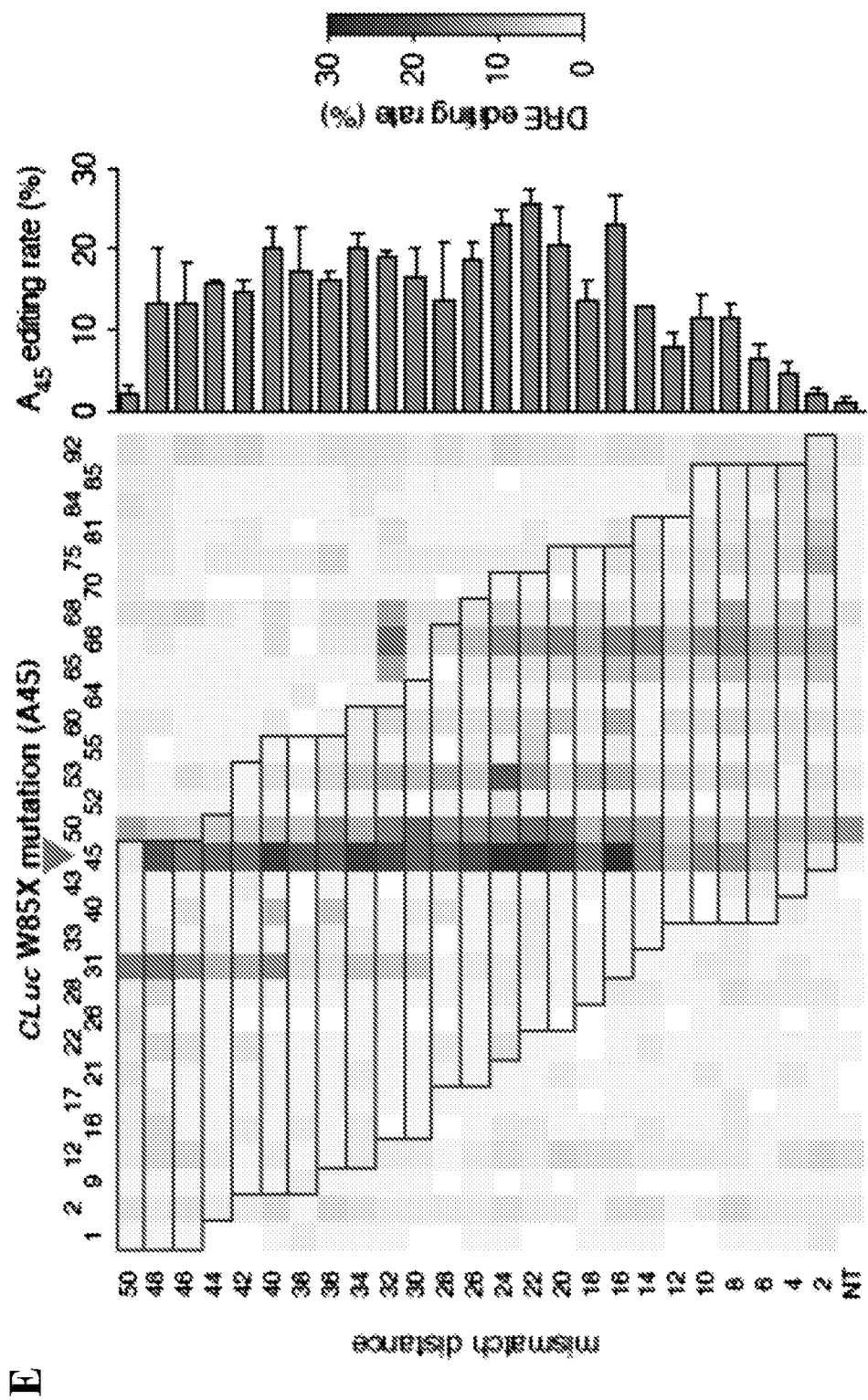
Figure 57C:
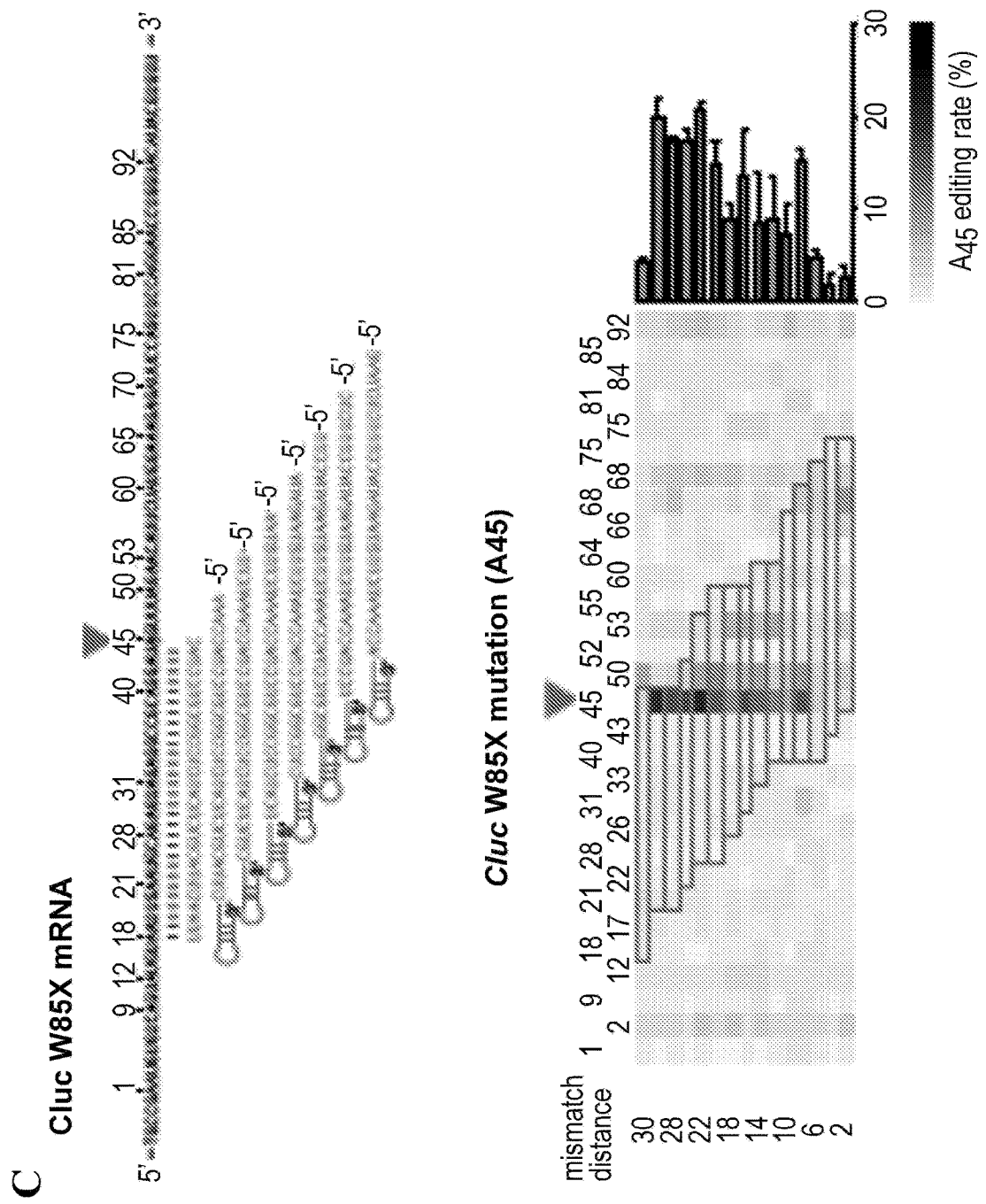

To validate that restoration of luciferase activity was due to bonafide editing events, we measured editing of Cluc transcripts subject to REPAIRv1 directly via reverse transcription and targeted next-generation sequencing. We tested 30- and 50-nt spacers around the target site and found that both guide lengths resulted in the expected A to I edit, with 50-nt spacers achieving higher editing percentages (FIGS. 50D, 50E, FIG. 57C). We also observed that 50-nt spacers had an increased propensity for editing at non-targeted adenosines, likely due to increased regions of duplex RNA (FIG. 50E, FIG. 57C).

Figure 57D:
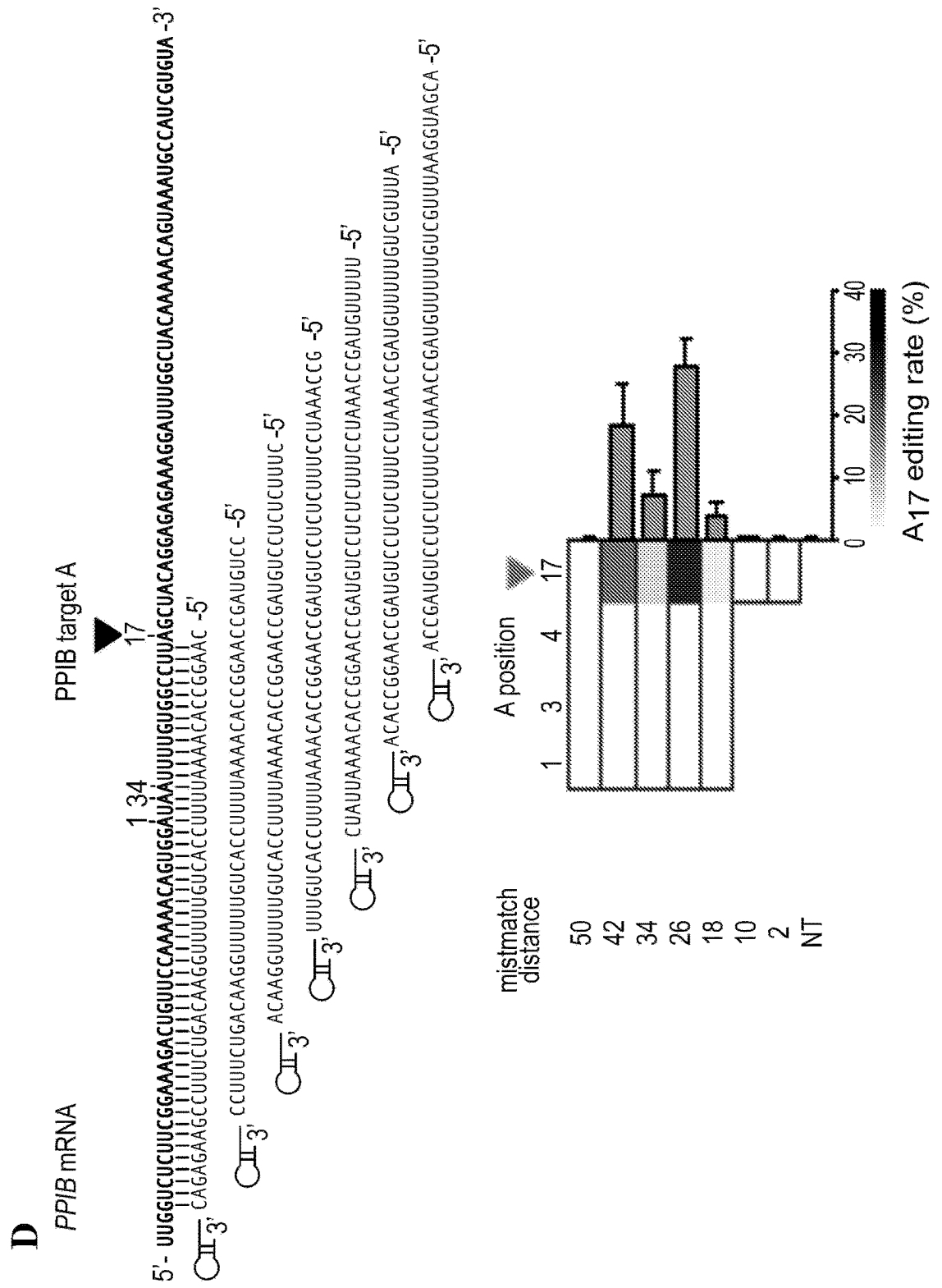

We next targeted an endogenous gene, PPIB. We designed 50-nt spacers tiling PPIB and found that we could edit the PPIB transcript with up to 28% editing efficiency (FIG. 57D). To test if REPAIR could be further optimized, we modified the linker between dCas13b and $ADAR2_{DD}$ (E488Q) (FIG. 57E, Table 8) and found that linker choice modestly affected luciferase activity restoration.

Defining the Sequence Parameters for RNA Editing

Figures 57E, 57F:
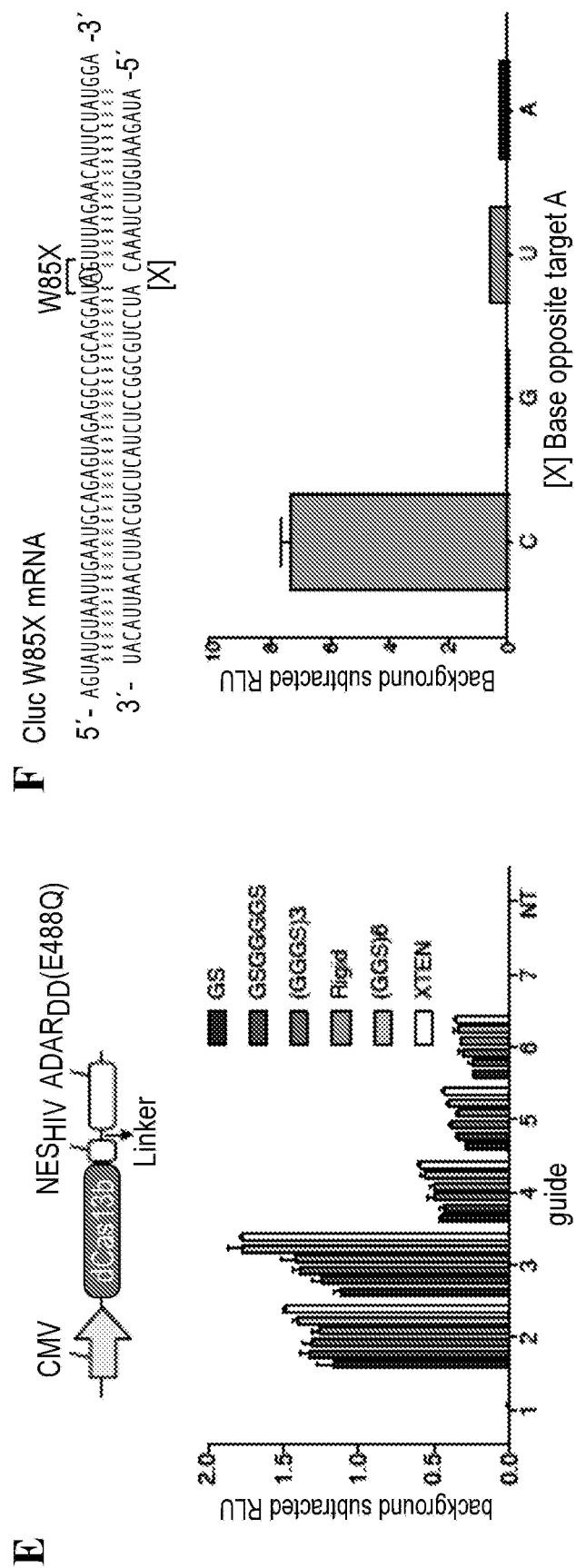

Given that we could achieve precise RNA editing at a test site, we wanted to characterize the sequence constraints for programming the system against any RNA target in the transcriptome. Sequence constraints could arise from dCas13b targeting limitations, such as the PFS, or from ADAR sequence preferences(26). To investigate PFS constraints on REPAIRv1, we designed a plasmid library carrying a series of four randomized nucleotides at the 5' end of a target site on the Cluc transcript (FIG. 51A). We targeted the center adenosine within either a UAG or AAC motif and found that for both motifs, all PFSs demonstrated detectable levels of RNA editing, with a majority of the PFSs having greater than 50% editing at the target site (FIG. 51B). Next, we sought to determine if the $ADAR2_{DD}$ in REPAIRv1 had any sequence constraints immediately flanking the targeted base, as has been reported previously for $ADAR2_{DD}$(26). We tested every possible combination of 5' and 3' flanking nucleotides directly surrounding the target adenosine (FIG. 51C), and found that REPAIRv1 was capable of editing all motifs (FIG. 51D). Lastly, we analyzed whether the identity of the base opposite the target A in the spacer sequence affected editing efficiency and found that an A-C mismatch had the highest luciferase restoration with A-G, A-U, and A-A having drastically reduced REPAIRv1 activity (FIG. 57F).

Correction of Disease-Relevant Human Mutations Using REPAIRv1

Figure 52A:
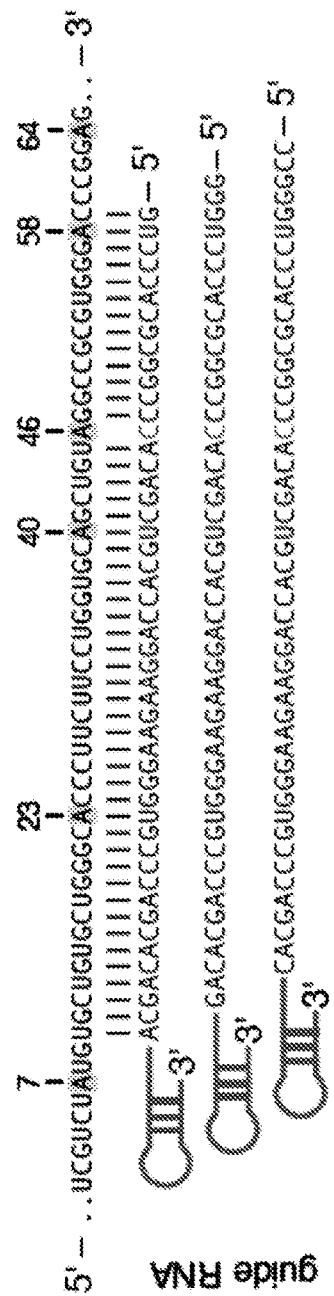
FIGS. 52A-52G: Correction of disease-relevant mutations with REPAIRv1 (FIG. 52A) Schematic of target and guide design for targeting AVPR2 878G>A. (SEQ ID Nos. 705-708) (FIG. 52B) The 878G>A mutation in AVPR2 is corrected to varying percentages using REPAIRv1 with three different guide designs.
Figure 52B:
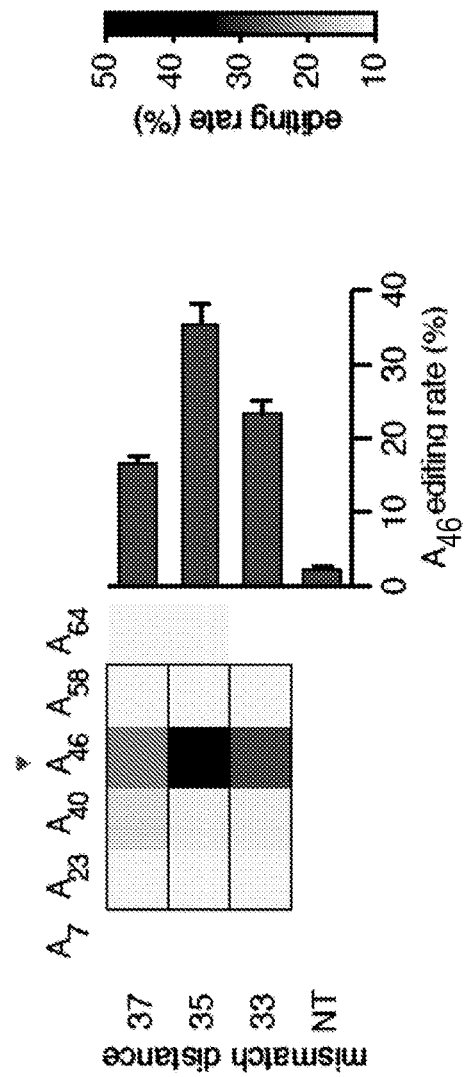
Figure 52C:
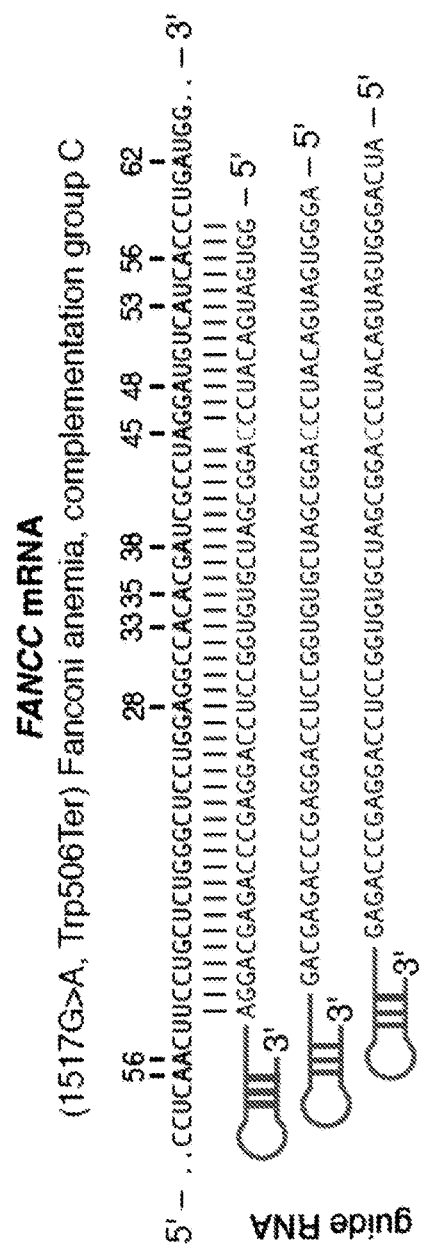
Figure 52D:
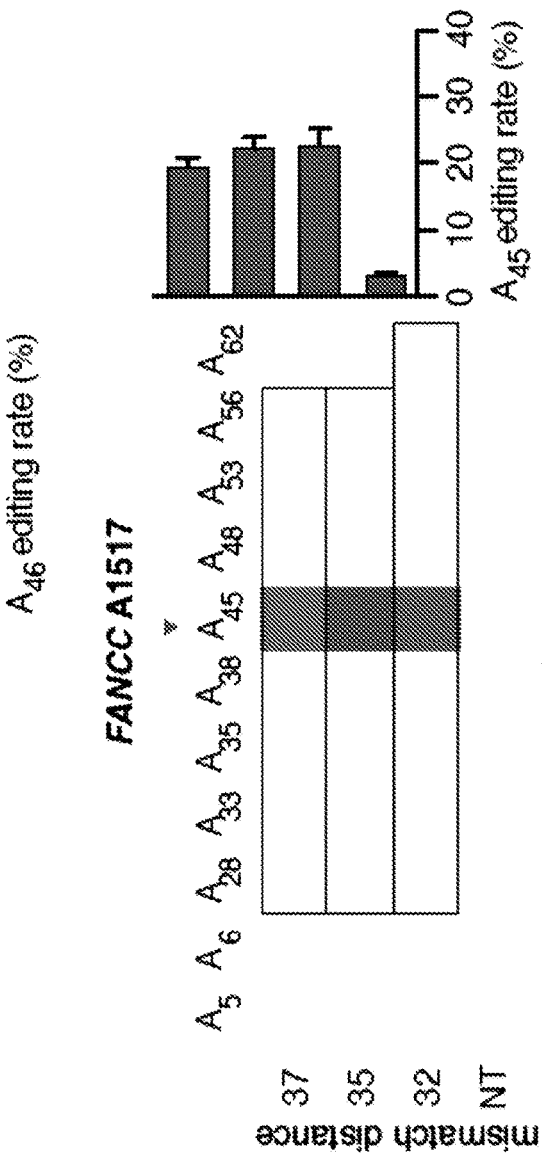
Figure 52E:
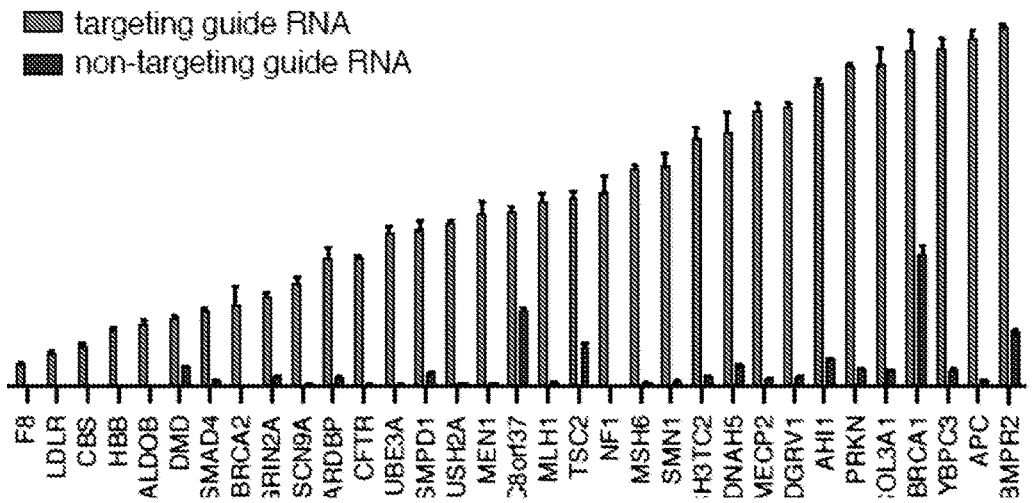
Figure 52F:
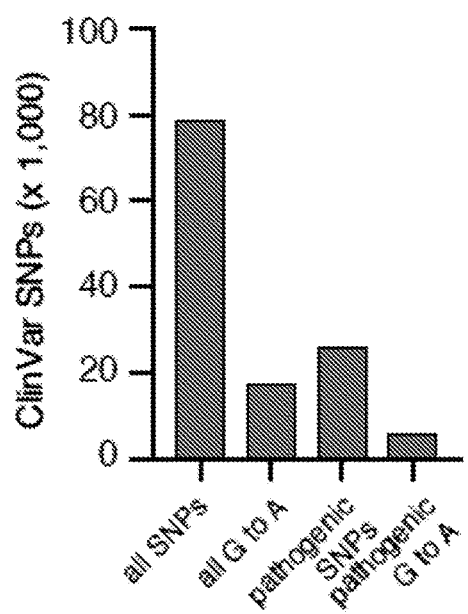
Figure 52G:
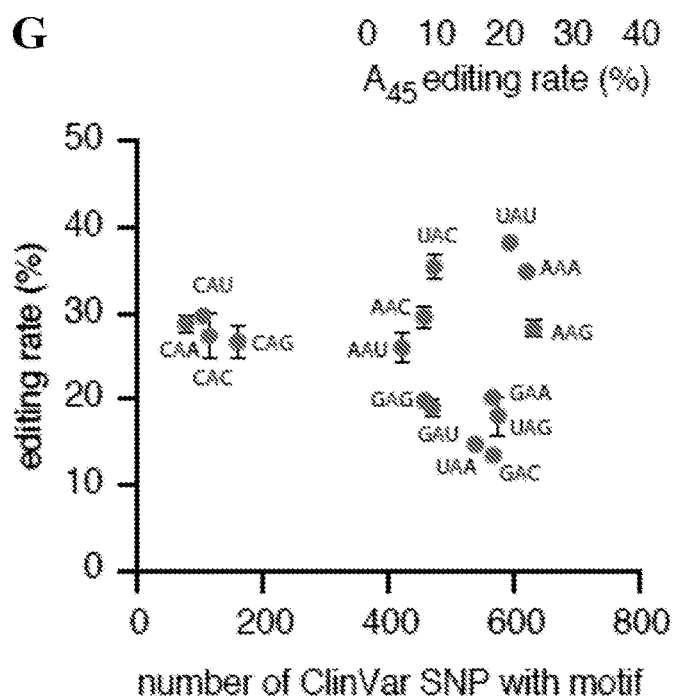
Figure 58:
FIG. 58: ClinVar motif distribution for G>A mutations. The number of each possible triplet motif observed in the ClinVar database for all G>A mutations.

To demonstrate the broad applicability of the REPAIRv1 system for RNA editing in mammalian cells, we designed REPAIRv1 guides against two disease relevant mutations: 878G>A (AVPR2 W293X) in X-linked Nephrogenic diabetes insipidus and 1517G>A (FANCC W506X) in Fanconi anemia. We transfected expression constructs for cDNA of genes carrying these mutations into HEK293FT cells and tested whether REPAIRv1 could correct the mutations. Using guide RNAs containing 50-nt spacers, we were able to achieve 35% correction of AVPR2 and 23% correction of FANCC (FIGS. 52A-52D). We then tested the ability of REPAIRv1 to correct 34 different disease-relevant G>A mutations (Table 9) and found that we were able to achieve significant editing at 33 sites with up to 28% editing efficiency (FIG. 52E). The mutations we chose are only a fraction of the pathogenic G to A mutations (5,739) in the ClinVar database, which also includes an additional 11,943 G to A variants (FIG. 52F and FIG. 58). Because there are no sequence constraints, REPAIRv1 is capable of potentially editing all these disease relevant mutations, especially given that we observed significant editing regardless of the target motif (FIG. 51C and FIG. 52G).

Figure 59:
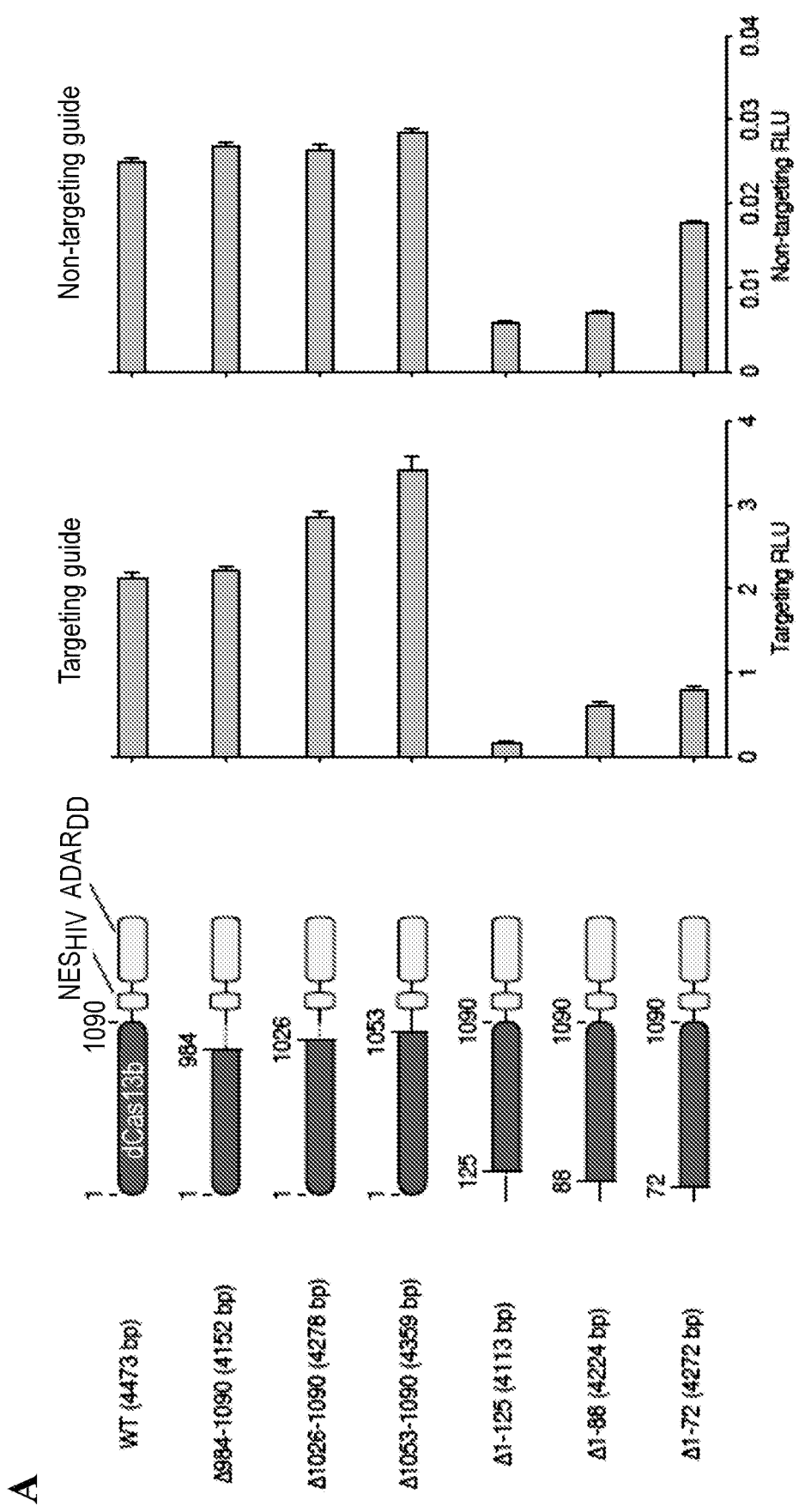
FIG. 59: Truncations of dCas13b still have functional RNA editing. Various N-terminal and C-terminal truncations of dCas13b allow for RNA editing as measured by restoration of luciferase signal.

Delivering the REPAIRv1 system to diseased cells is a prerequisite for therapeutic use, and we therefore sought to design REPAIRv1 constructs that could be packaged into therapeutically relevant viral vectors, such as adeno-associated viral (AAV) vectors. AAV vectors have a packaging limit of 4.7 kb, which cannot accommodate the large size of dCas13b-$ADAR_{DD}$ (4473 bp) along with promoter and expression regulatory elements. To reduce the size, we tested a variety of N-terminal and C-terminal truncations of dCas13 fused to $ADAR2_{DD}$(E488Q) for RNA editing activity. We found that all C-terminal truncations tested were still functional and able to restore luciferase signal (FIG. 59), and the largest truncation, C-terminal A984-1090 (total size of the fusion protein 4,152 bp) was small enough to fit within the packaging limit of AAV vectors.

Transcriptome-Wide Specificity of REPAIRv1

Figure 53A:
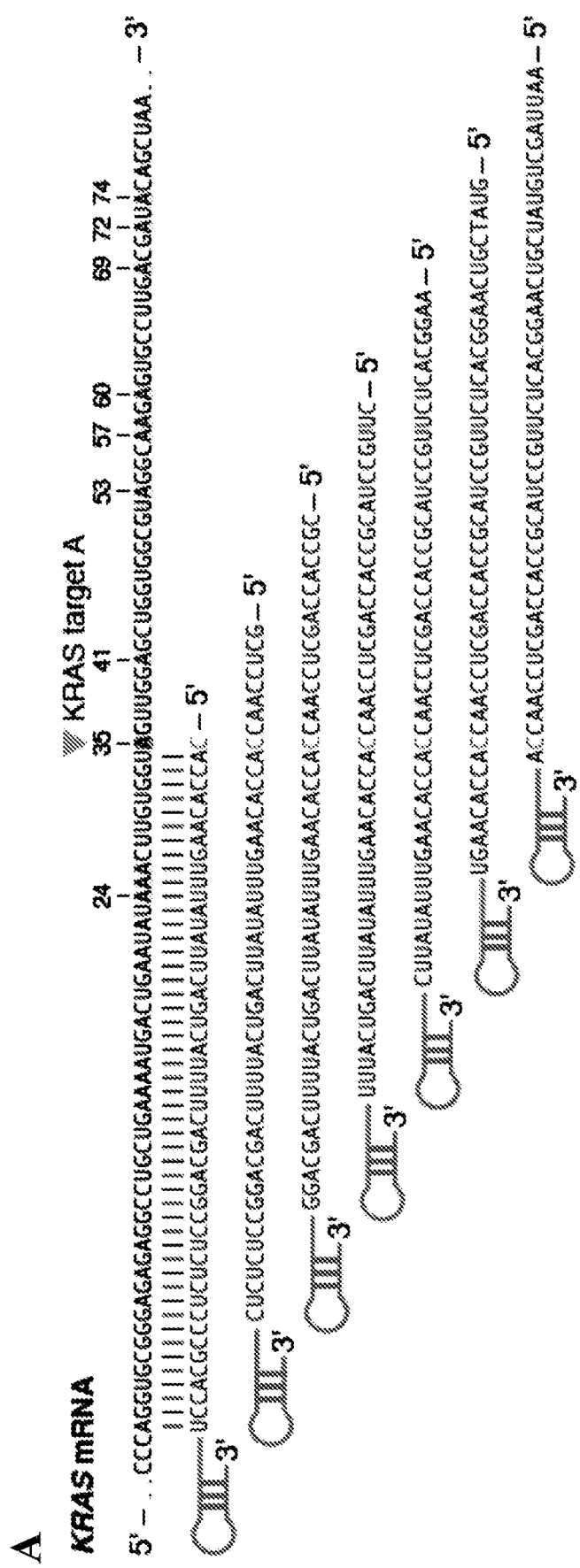

Although RNA knockdown with PspCas13b was highly specific, in our luciferase tiling experiments, we observed off-target adenosine editing within the guide:target duplex (FIG. 50E). To see if this was a widespread phenomenon, we tiled an endogenous transcript, KRAS, and measured the degree of off-target editing near the target adenosine (FIG. 53A). We found that for KRAS, while the on-target editing rate was 23%, there were many sites around the target site that also had detectable A to G edits (FIG. 53B).

Because of the observed off-target editing within the guide:target duplex, we evaluated all possible transcriptome off-targets by performing RNA sequencing on all mRNAs. RNA sequencing revealed that there was a significant number A to G off-target events, with 1,732 off-targets in the targeting condition and 925 off-targets in the non-targeting condition, with 828 off-targets overlapping (FIGS. 53C, 53D). Of all the editing sites across the transcriptome, the on-target editing site had the highest editing rate, with 89% A to G conversion.

Figure 60B:
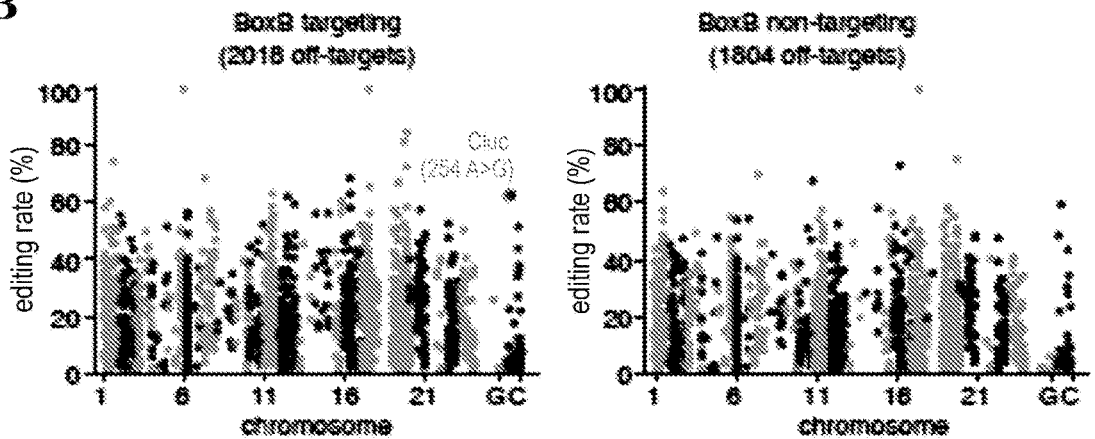
Figure 60C:
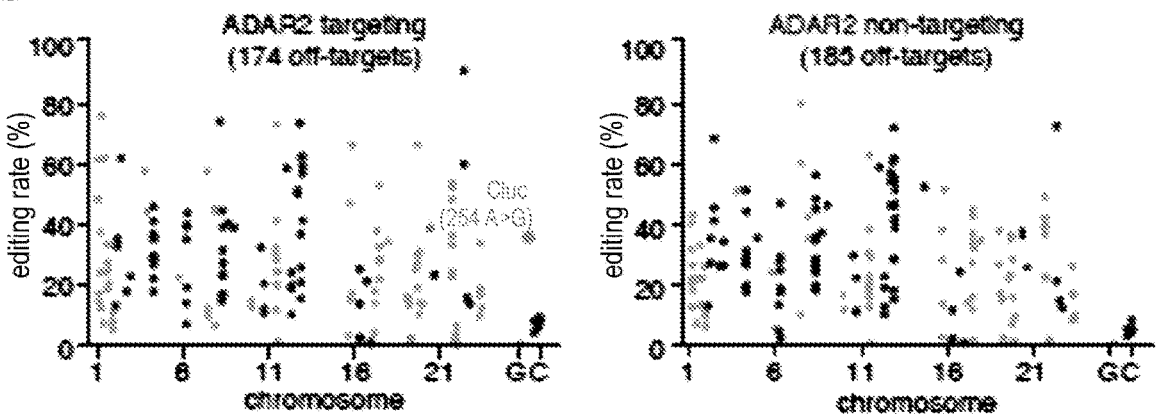
Figure 60D:
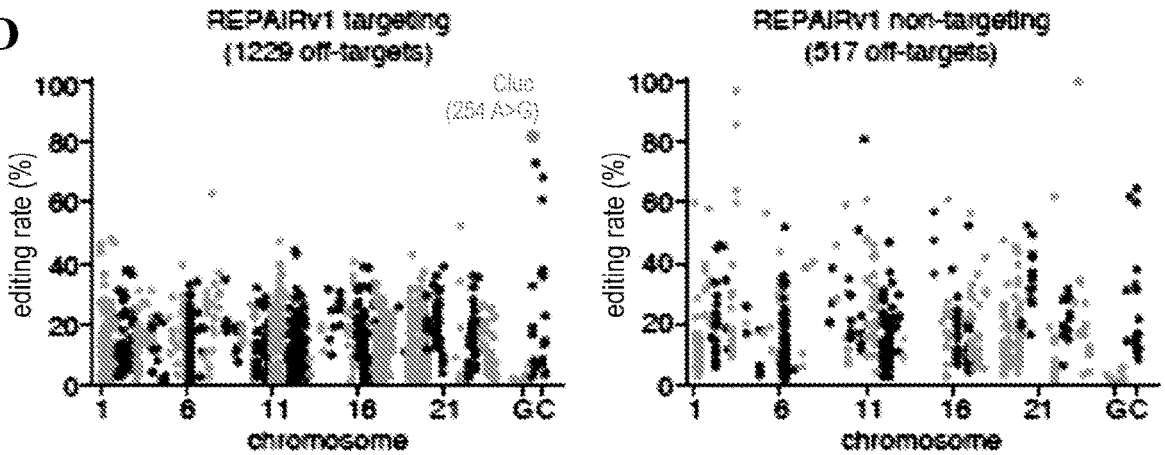
Figures 60E, 60F:
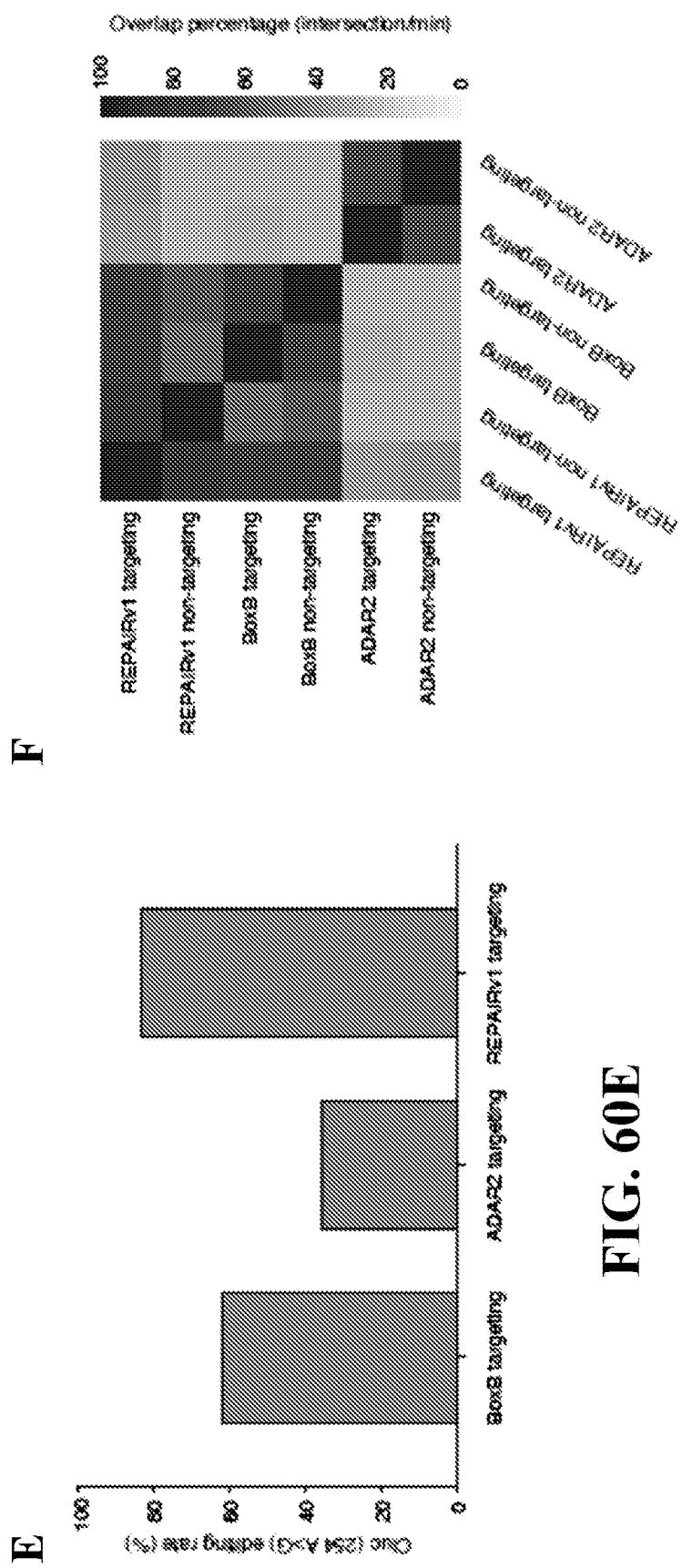

Given the high specificity of Cas13 targeting, we reasoned that the off-targets may arise from ADAR. Two RNA-guided ADAR systems have been described previously (FIG. 60A). The first utilizes a fusion of $ADAR2_{DD}$ to the small viral protein lambda N ($\lambda$N), which binds to the BoxB-A RNA hairpin(22). A guide RNA with double BoxB-$\lambda$hairpins guides $ADAR2_{DD}$ to edit sites encoded in the guide RNA (23). The second design utilizes full length ADAR2 (ADAR2) and a guide RNA with a hairpin that the double strand RNA binding domains (dsRBDs) of ADAR2 recognize(21, 24). We analyzed the editing efficiency of these two systems compared to REPAIRv1 and found that the BoxB-ADAR2 and ADAR2 systems demonstrated 63% and 36% editing rates, respectively, compared to the 89% editing rate achieved by REPAIRv1 (FIGS. 60B-60E). Additionally, the BoxB and ADAR2 systems created 2018 and 174 observed off targets, respectively, in the targeting guide conditions, compared to the 1,229 off targets in the REPAIRv1 targeting guide condition. Notably, all the conditions with the two $ADAR2_{DD}$-based systems (REPAIRv1 and BoxB) showed a high percentage of overlap in their off-targets while the ADAR2 system had a largely distinct set of off-targets (FIG. 60F). The overlap in off-targets between the targeting and non-targeting conditions and between REPAIRv1 and BoxB conditions suggest $ADAR2_{DD}$ drove off-targets independent of dCas13 targeting (FIG. 60F).

Improving Specificity of REPAIRv1 Through Rational Protein Engineering

Figure 54A:
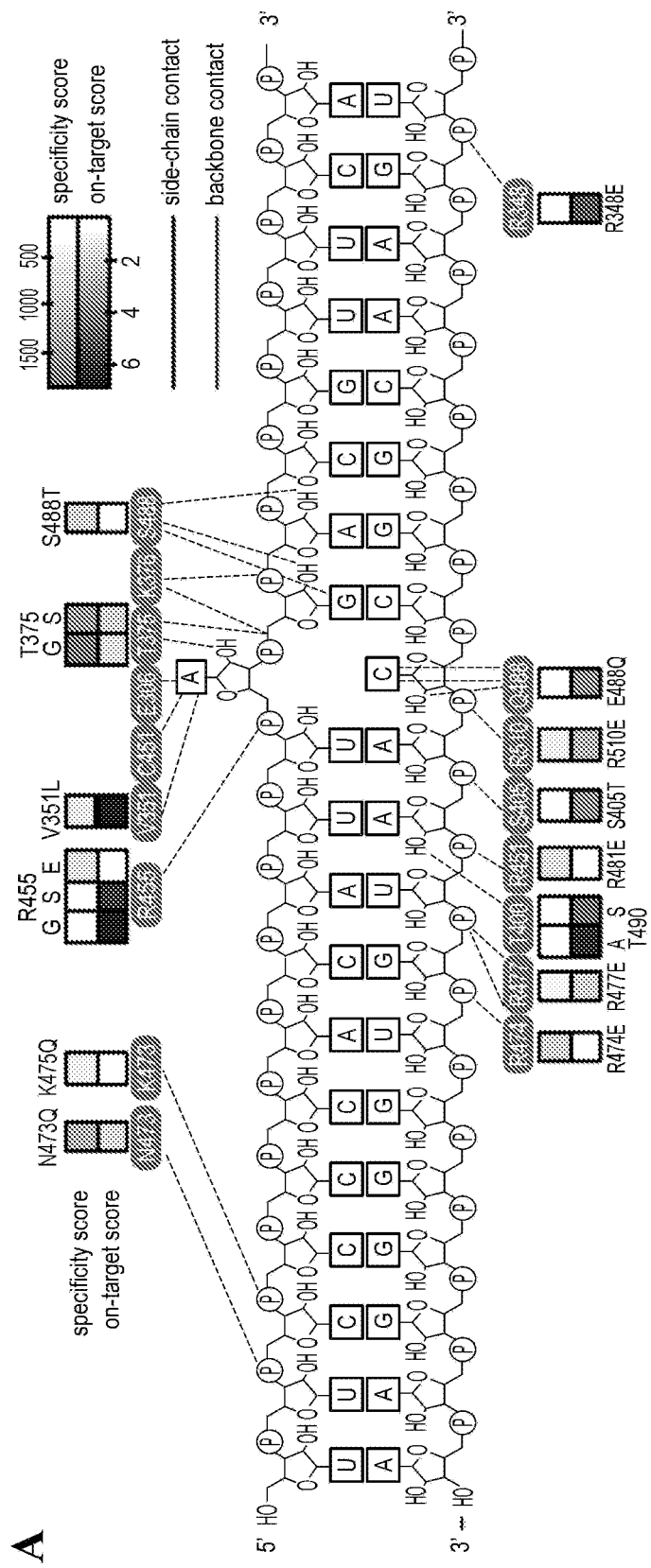
Figure 62A:
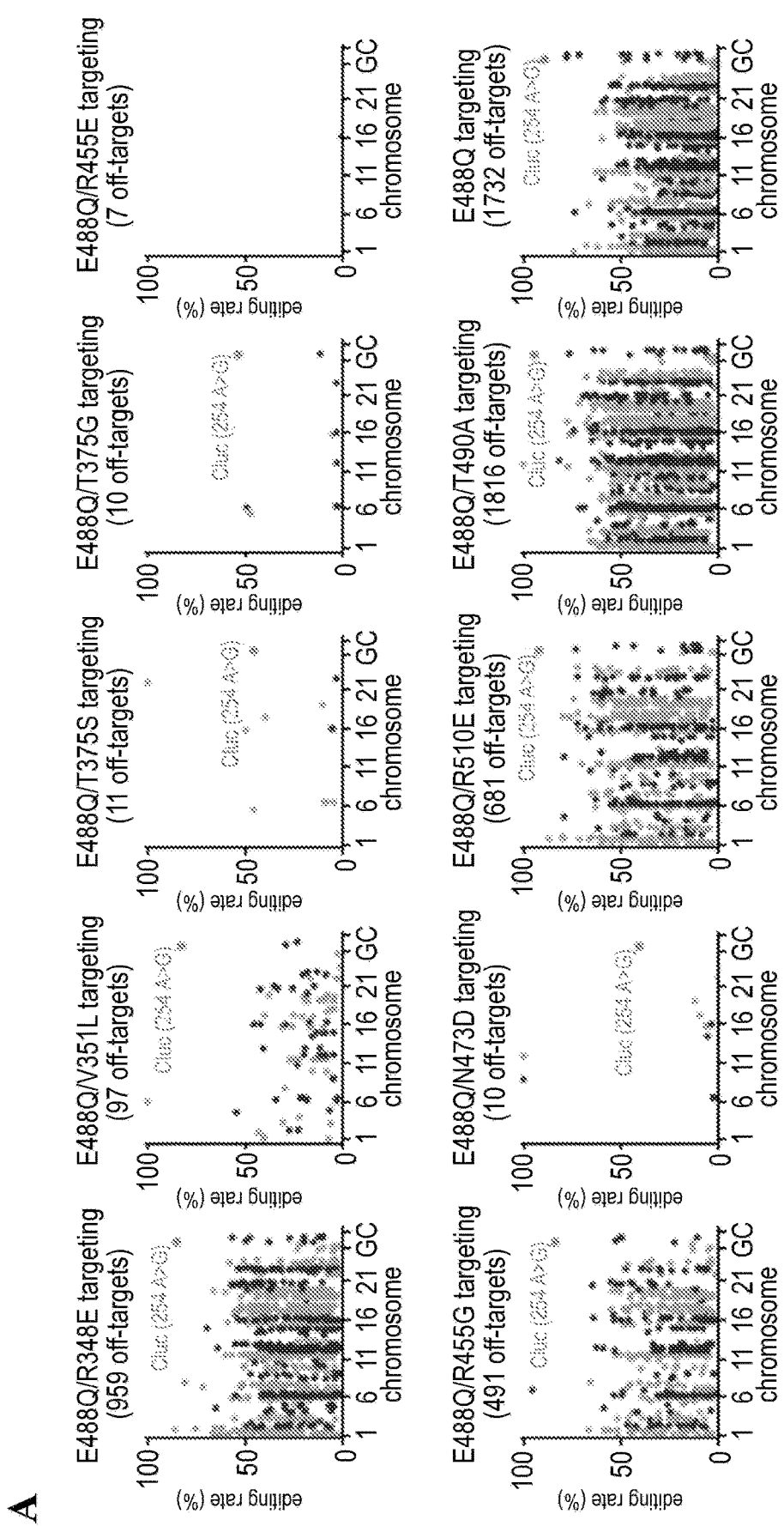
FIGS. 62A-62B: Transcriptome-wide specificity of RNA editing by dCas13b-ADAR2$_{DD}$(E488Q) mutants (FIG. 62A) Transcriptome-wide sites of significant RNA editing by dCas13b-ADAR2$_{DD}$(E488Q) mutants with a guide targeting Cluc. The on-target Cluc site (254 A>G) is highlighted in orange.
Figure 62B:
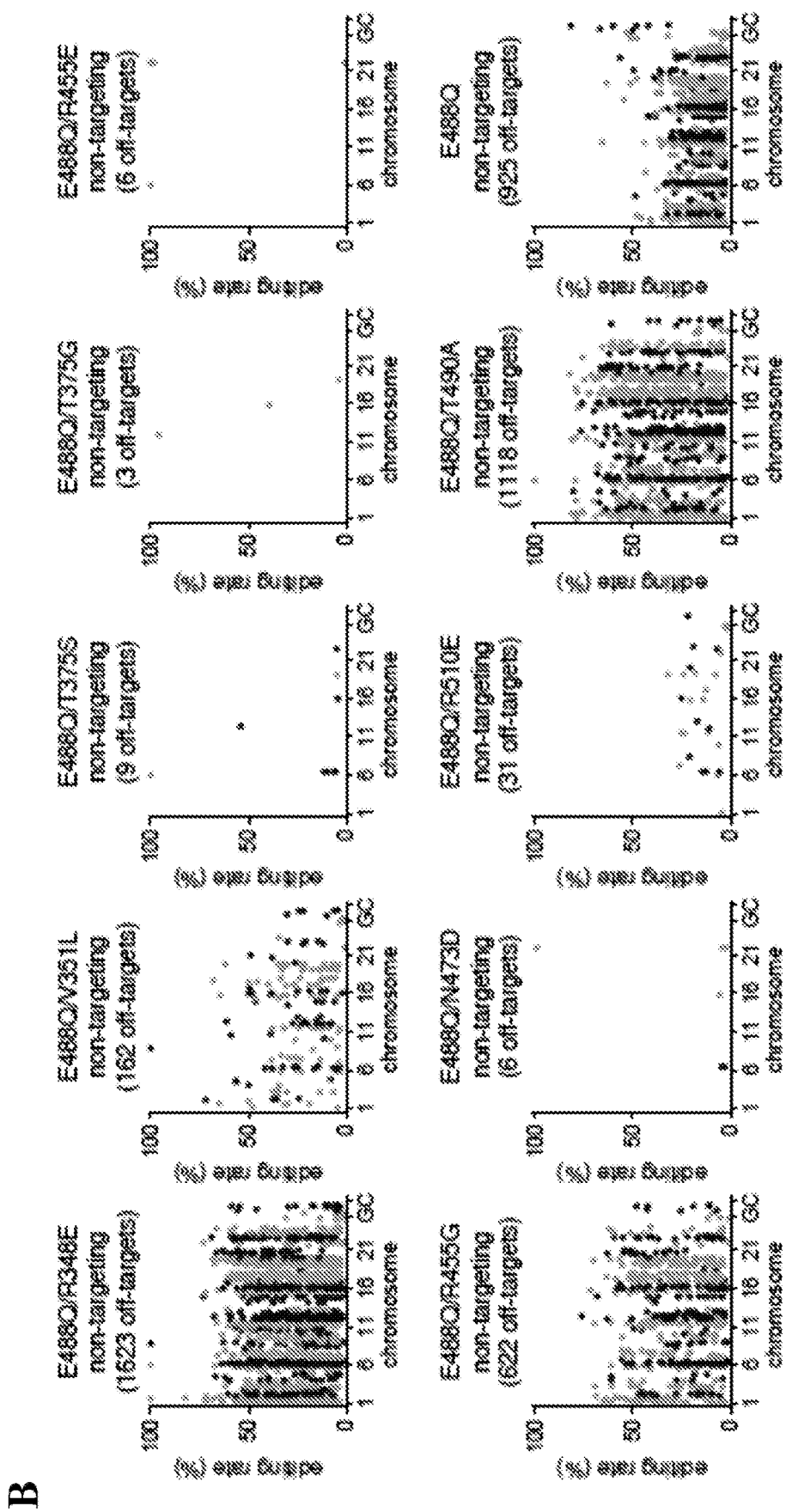
Figure 63A:
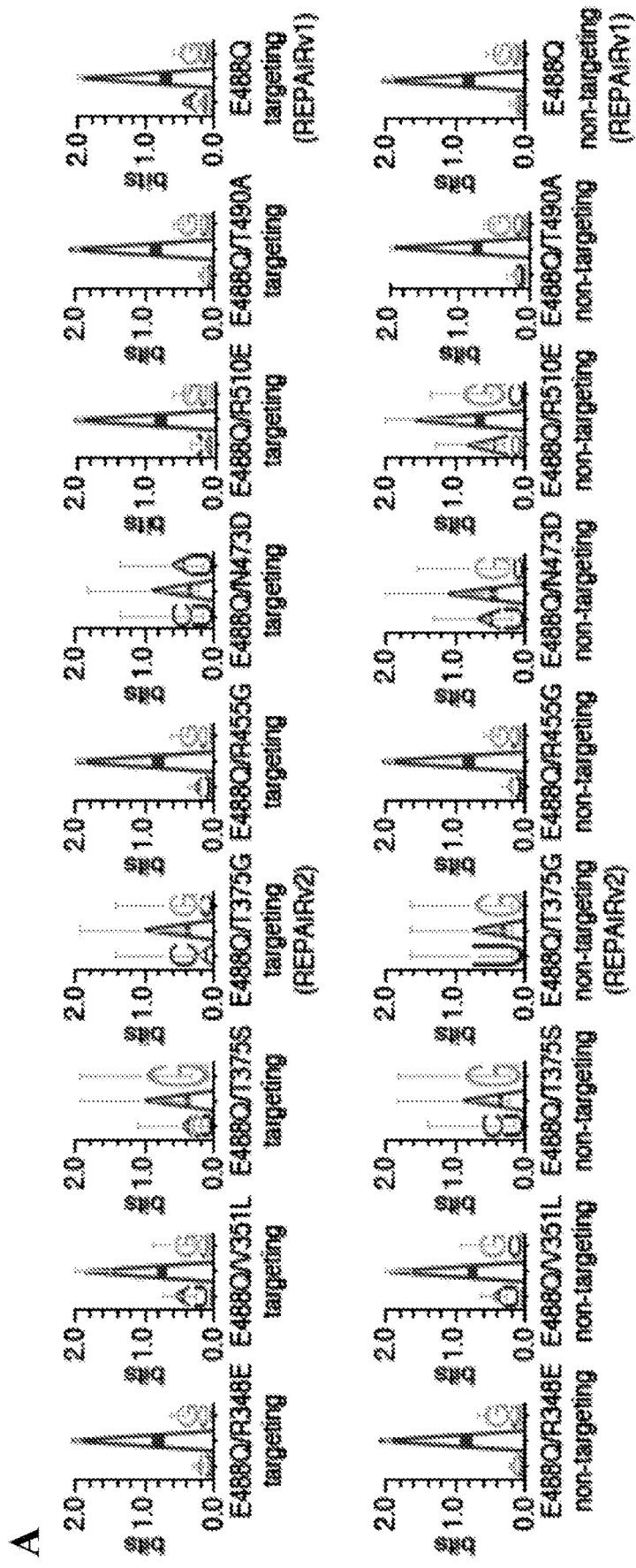
FIGS. 63A-63C: Characterization of motif biases in the off-targets of dCas13b-ADAR2$_{DD}$(E488Q) editing.
Figure 63C:
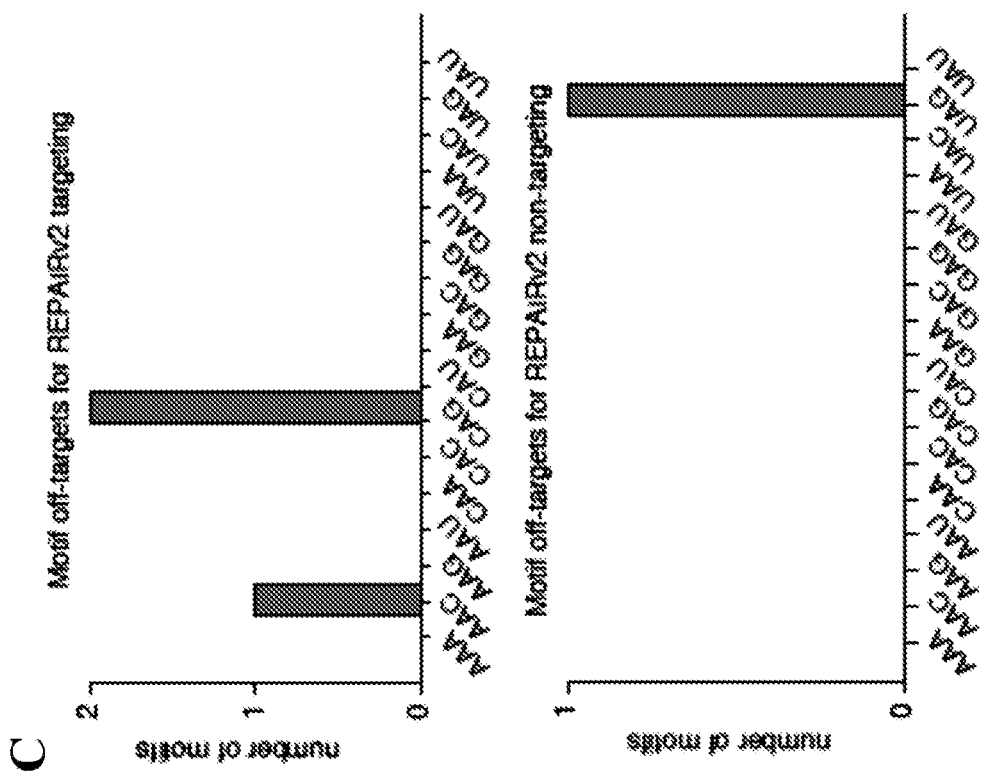
Figure 63B:
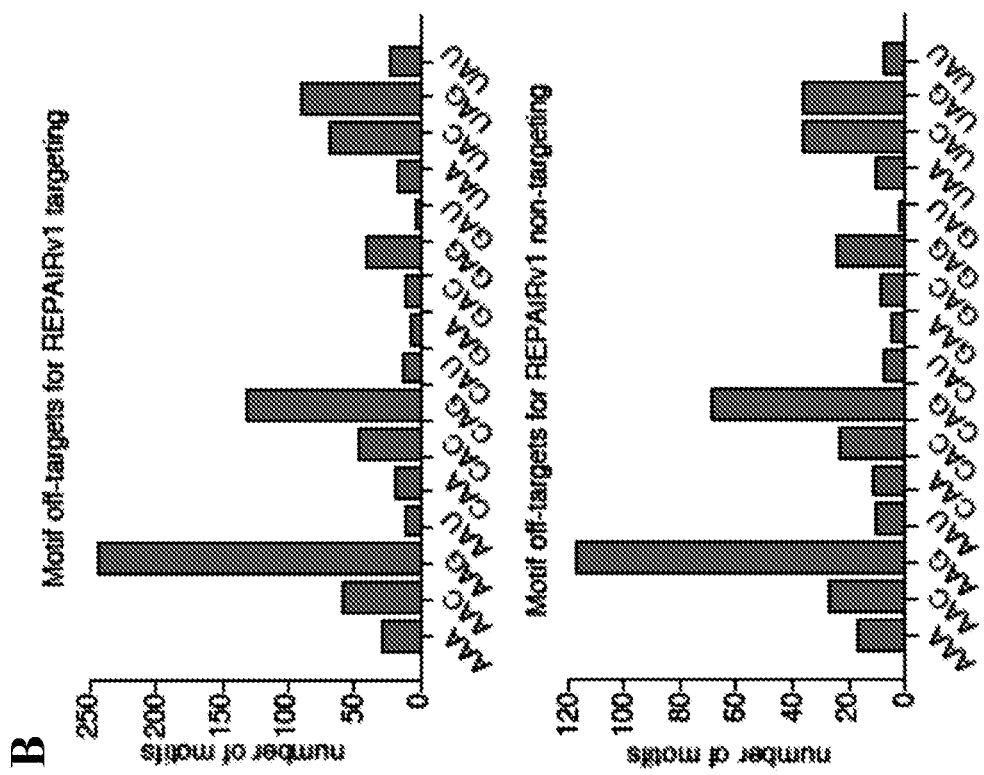
Figure 68:
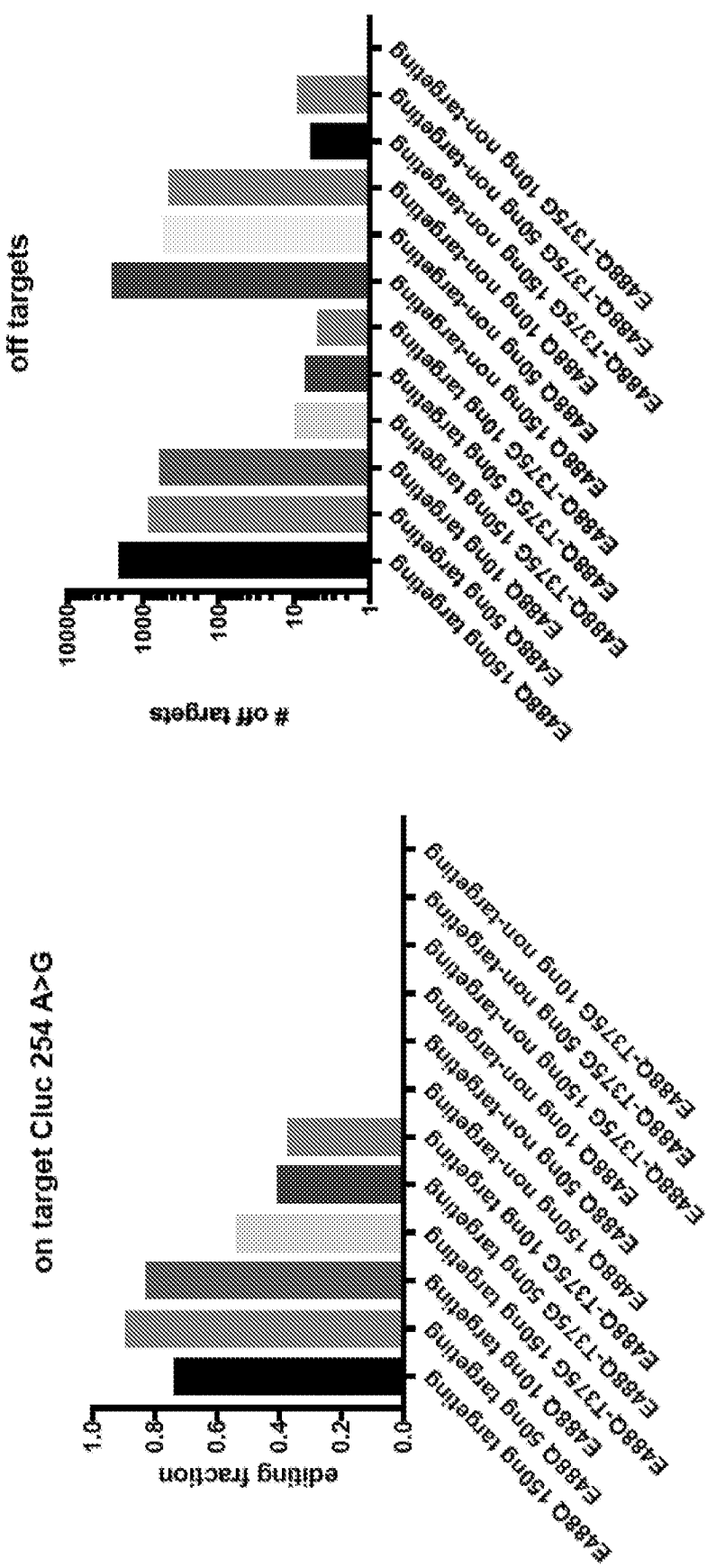
FIG. 68: Potential effect of dosage on off target activity.

To improve the specificity of REPAIR, we employed structure-guided protein engineering of $ADAR2_{DD}$(E488Q). Because of the guide-independent nature of off-targets, we hypothesized that destabilizing $ADAR2_{DD}$(E488Q)-RNA binding would selectively decrease off-target editing, but maintain on-target editing due to increased local concentration from dCas13b tethering of $ADAR2_{DD}$(E488Q) to the target site. We mutagenized $ADAR2_{DD}$(E488Q) residues previously determined to contact the duplex region of the target RNA (FIG. 54A)(18) on the $ADAR2_{DD}$(E488Q) background. To assess efficiency and specificity, we tested 17 single mutants with both targeting and non-targeting guides, under the assumption that background luciferase restoration in the non-targeting condition detected would be indicative of broader off-target activity. We found that mutations at the selected residues had significant effects on the luciferase activity for targeting and non-targeting guides (FIGS. 54A, 54B, FIG. 61A). A majority of mutants either significantly improved the luciferase activity for the targeting guide or increased the ratio of targeting to non-targeting guide activity, which we termed the specificity score (FIGS. 54A, 54B). We selected a subset of these mutants (FIG. 54B) for transcriptome-wide specificity profiling by next generation sequencing. As expected, off-targets measured from transcriptome-wide sequencing correlated with our specificity score (FIG. 61B) for mutants. We found that with the exception of $ADAR2_{DD}$(E488Q/R455E), all sequenced REPAIRv1 mutants could effectively edit the reporter transcript (FIG. 54C), with many mutants showing reduction in the number of off-targets (FIGS. 61C, 62). We further explored the surrounding motifs of off-targets for specificity mutants, and found that REPAIRv1 and most of the engineered mutants exhibited a strong 3' G preference for their edits, in agreement with the characterized ADAR2 motif (FIG. 63A)(26). We selected the mutant $ADAR2_{DD}$(E488Q/T375G) for future experiments, as it had the highest percent editing of the four mutants with the lowest numbers of transcriptome-wide off targets and termed it REPAIRv2. Compared to REPAIRv1, REPAIRv2 exhibited increased specificity, with a reduction from 1732 to 10 transcriptome off-targets (FIG. 54D). In the region surrounding the targeted adenosine in Cluc, REPAIRv2 had reduced off-target editing, visible in sequencing traces (FIG. 54E). In motifs derived from next-generation sequencing, REPAIRv1 presented a strong preference towards 3' G, but showed off-targeting edits for all motifs (FIG. 63B); by contrast, REPAIRv2 only edited the strongest off-target motifs (FIG. 63C). The distribution of edits on transcripts was heavily skewed, with highly-edited genes having over 60 edits (FIGS. 64A, 64B), whereas REPAIRv2 only edited one transcript (EEF1A1) multiple times (FIGS. 64D-64F). REPAIRv1 off-target edits were predicted to result in numerous variants, including 1000 missense mutations (FIG. 64C) with 93 oncogenic events (FIG. 64D). In contrast, REPAIRv2 only had 6 missense mutations (FIG. 64E), none of which had oncogenic consequences (FIG. 64F). This reduction in predicted off-target effects distinguishes REPAIRv2 from other RNA editing approaches. Experiments with different dosages of guide RNA suggests that dose response may reduce off target activity (FIG. 68)

Figure 54F:
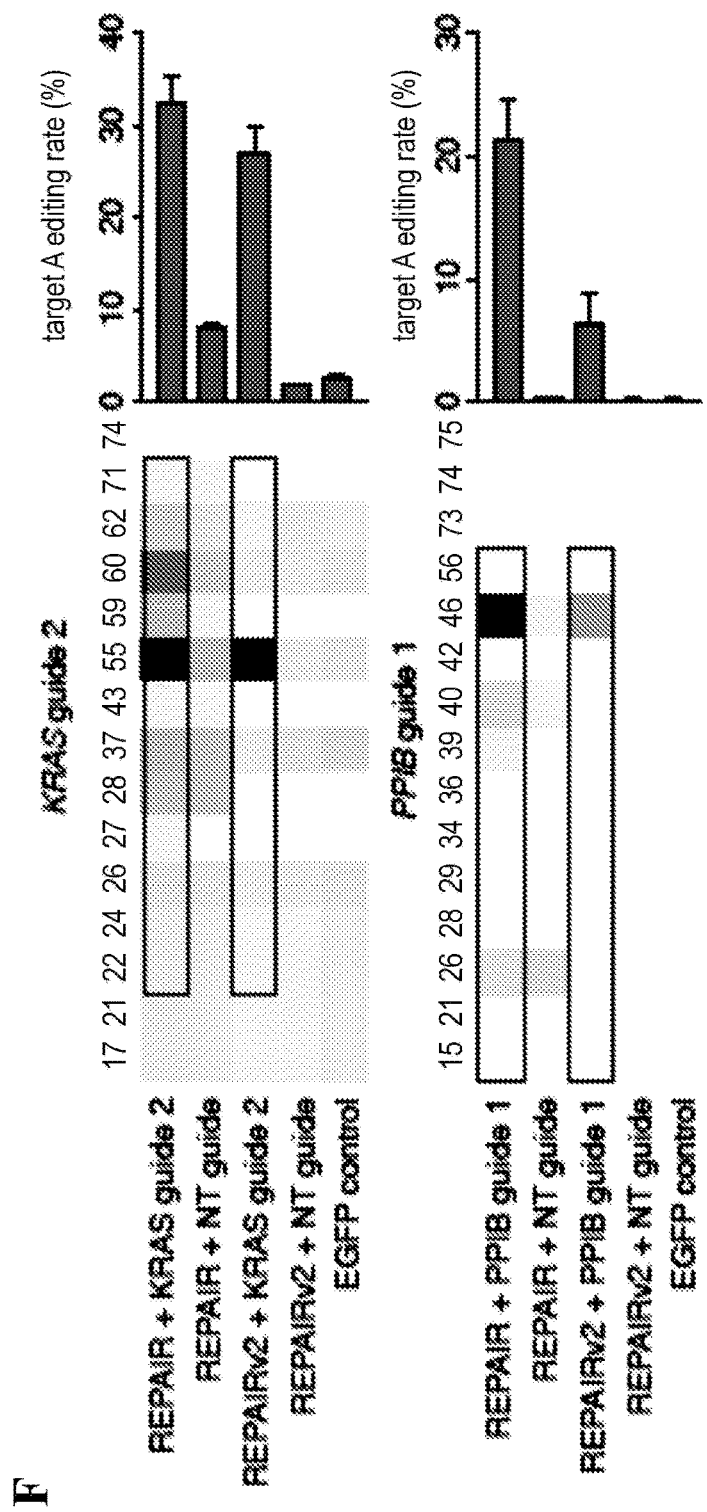
Figure 65A:
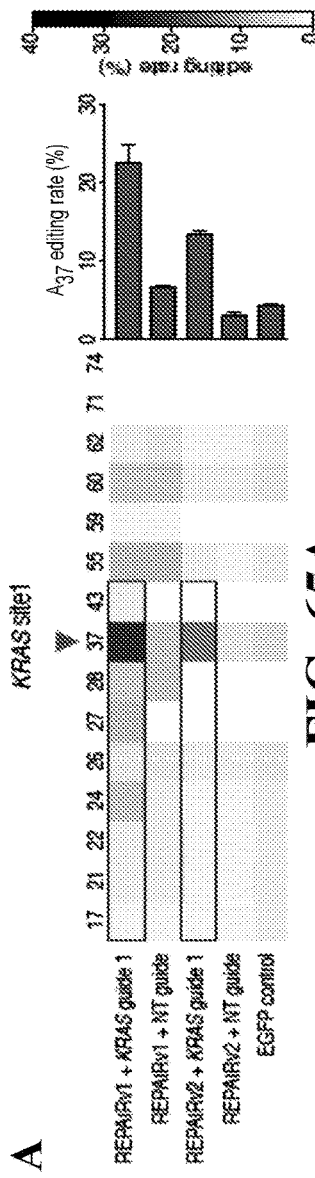
FIGS. 65A-65C: RNA editing efficiency and specificity of REPAIRv1 and REPAIRv2.
Figure 65B:
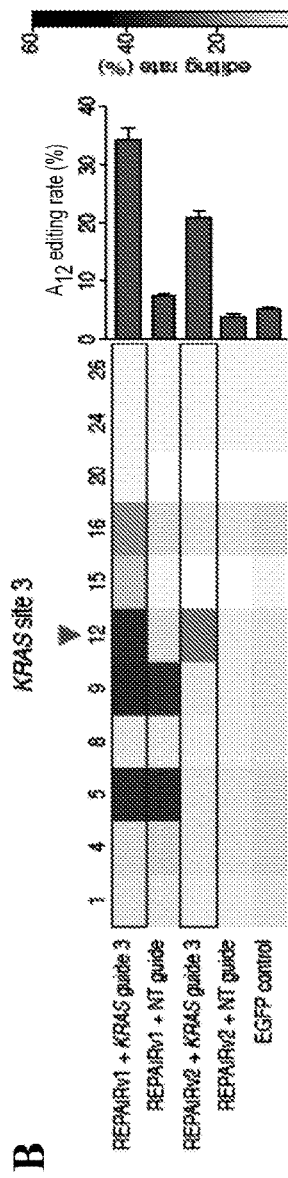
Figure 65C:
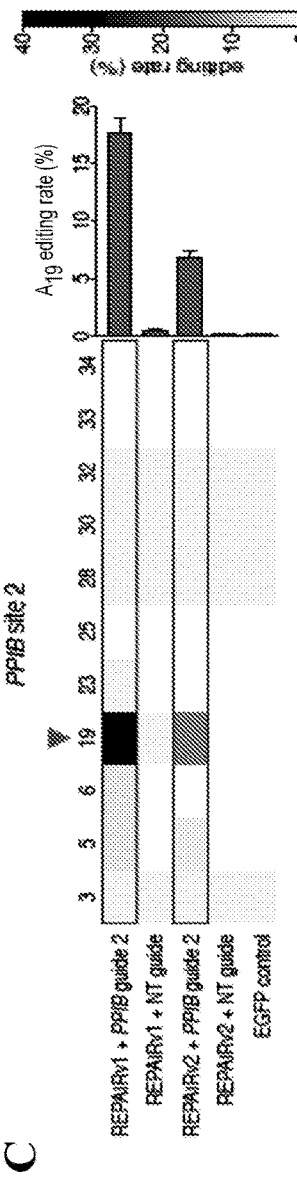
Figure 66C:
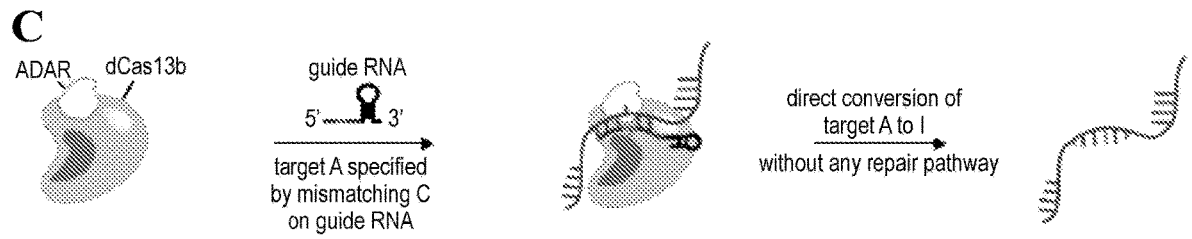
Figure 66D:
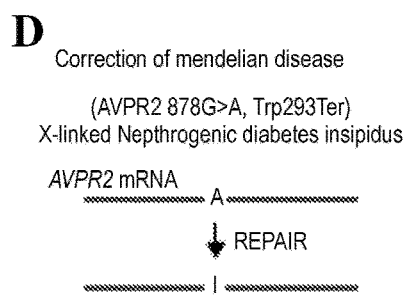
Figure 66E:
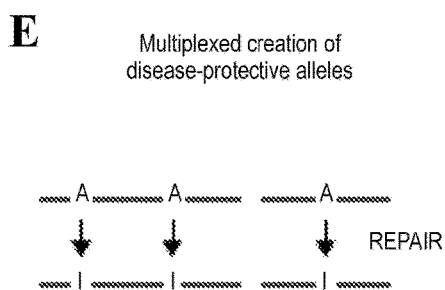
Figure 66F:
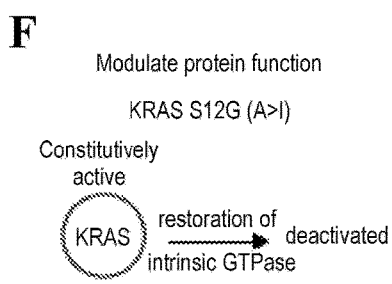
Figure 66G:
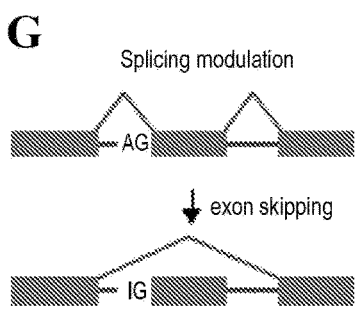

We targeted REPAIRv2 to endogenous genes to test if the specificity-enhancing mutations reduced nearby edits in target transcripts while maintaining high-efficiency on-target editing. For guides targeting either KRAS or PPIB, we found that REPAIRv2 had no detectable off-target edits, unlike REPAIRv1, and could effectively edit the on-target adenosine at 27.1% and 13%, respectively (FIGS. 54F, 54G). This specificity extended to additional target sites, including regions that demonstrate high-levels of background in non-targeting conditions for REPAIRv1, such as other KRAS or PPIB target sites (FIGS. 65A-65C). Overall, REPAIRv2 eliminated off-targets in duplexed regions around the edited adenosine and showed dramatically enhanced transcriptome-wide specificity.

Conclusion

We have shown here that the RNA-guided RNA-targeting type VI-B effector Cas13b is capable of highly efficient and specific RNA knockdown, providing the basis for improved tools for interrogating essential genes and non-coding RNA as well as controlling cellular processes at the transcriptomic level. Catalytically inactive Cas13b (dCas13b) retains programmable RNA binding capability, which we leveraged here by fusing dCas13b to the adenosine deaminase ADAR2 to achieve precise A to I edits, a system we term REPAIRv1 (RNA Editing for Programmable A to I Replacement version 1). Further engineering of the system produced REPAIRv2, a method with comparable or increased activity relative to current editing platforms with dramatically improved specificity.

Although Cas13b exhibits high fidelity, our initial results with dCas13b-ADAR2$_{DD}$ fusions revealed thousands of off-targets. To address this, we employed a rational mutagenesis strategy to vary the ADAR2DD residues that contact the RNA duplex, identifying a variant, ADAR2$_{DD}$(E488Q/T375G), capable of precise, efficient, and highly specific editing when fused to dCas13b. Editing efficiency with this variant was comparable to or better than that achieved with two currently available systems, BoxB-ADAR$_{DD}$ or ADAR2 editing. Moreover, the REPAIRv2 system created only 10 observable off-targets in the whole transcriptome, at least an order of magnitude better than both alternative editing technologies.

The REPAIR system offers many advantages compared to other nucleic acid editing tools. First, the exact target site can be encoded in the guide by placing a cytidine within the guide extension across from the desired adenosine to create a favorable A-C mismatch ideal for ADAR editing activity. Second, Cas13 has no targeting sequence constraints, such as a PFS or PAM, and no motif preference surrounding the target adenosine, allowing any adenosine in the transcriptome to be potentially targeted with the REPAIR system. We do note, however, that DNA base editors can target either the sense or anti-sense strand, while the REPAIR system is limited to transcribed sequences, thereby constraining the total number of possible editing sites we could target. However, due to the more flexible nature of targeting with REPAIR, this system can effect more edits within ClinVar (FIG. 52C) than Cas9-DNA base editors. Third, the REPAIR system directly deaminates target adenosines to inosines and does not rely on endogenous repair pathways, such as base-excision or mismatch repair, to generate desired editing outcomes. Thus, REPAIR should be possible in non-dividing cells that cannot support other forms of editing. Fourth, RNA editing can be transient, allowing the potential for temporal control over editing outcomes. This property will likely be useful for treating diseases caused by temporary changes in cell state, such as local inflammation.

The REPAIR system provides multiple opportunities for additional engineering. Cas13b possesses pre-crRNA processing activity(13), allowing for multiplex editing of multiple variants, which alone might not alter disease risk, but together might have additive effects and disease-modifying potential. Extension of our rational design approach, such as combining promising mutations, could further increase the specificity and efficiency of the system, while unbiased screening approaches could identify additional residues for improving REPAIR activity and specificity.

Currently, the base conversions achievable by REPAIR are limited to generating inosine from adenosine; additional fusions of dCas13 with other catalytic RNA editing domains, such as APOBEC, could enable cytidine to uridine editing. Additionally, mutagenesis of ADAR could relax the substrate preference to target cytidine, allowing for the enhanced specificity conferred by the duplexed RNA substrate requirement to be exploited by C→U editors. Adenosine to inosine editing on DNA substrates may also be possible with catalytically inactive DNA-targeting CRISPR effectors, such as dCas9 or dCpf1, either through formation of DNA-RNA heteroduplex targets(27) or mutagenesis of the ADAR domain.

REPAIR could be applied towards a range of therapeutic indications where A to I (A to G) editing can reverse or slow disease progression (FIGS. 66A-66G). First, expression of REPAIR for targeting causal, Mendelian G to A mutations in disease-relevant tissues could be used to revert deleterious mutations and treat disease. For example, stable REPAIR expression via AAV in brain tissue could be used to correct the GRIN2A missense mutation c.2191G>A (Asp731Asn) that causes focal epilepsy(28) or the APP missense mutation c.2149G>A (Val717Ile) causing early-onset Alzheimer's disease(29). Second, REPAIR could be used to treat disease by modifying the function of proteins involved in disease-related signal transduction. For instance, REPAIR editing would allow the re-coding of some serine, threonine and tyrosine residues that are the targets of kinases (FIGS. 66A-66G). Phosphorylation of these residues in disease-relevant proteins affects disease progression for many disorders including Alzheimer's disease and multiple neurodegenerative conditions(30). Third, REPAIR could be used to change the sequence of expressed, risk-modifying G to A variants to pre-emptively decrease the chance of entering a disease state for patients. The most intriguing case are the 'protective' risk-modifying alleles, which dramatically decrease the chance of entering a disease state, and in some cases, confer additional health benefits. For instance, REPAIR could be used to functionally mimic A to G alleles of PCSK9 and IFIH1 that protect against cardiovascular disease and psoriatic arthritis(31), respectively. Last, REPAIR can be used to therapeutically modify splice acceptor and donor sites for exon modulation therapies. REPAIR can change AU to IU or AA to AI, the functional equivalent of the consensus 5' splice donor or 3' splice acceptor sites respectively, creating new splice junctions. Additionally, REPAIR editing can mutate the consensus 3' splice acceptor site from AG→IG to promote skipping of the adjacent downstream exon, a therapeutic strategy that has received significant interest for the treatment of DMD. Modulation of splice sites could have broad applications in diseases where anti-sense oligos have had some success, such as for modulation of SMN2 splicing for treatment of spinal muscular atrophy(32).

We have demonstrated the use of the PspCas13b enzyme as both an RNA knockdown and RNA editing tool. The dCas13b platform for programmable RNA binding has many applications, including live transcript imaging, splicing modification, targeted localization of transcripts, pull down of RNA-binding proteins, and epitranscriptomic modifications. Here, we used dCas13 to create REPAIR, adding to the existing suite of nucleic acid editing technologies. REPAIR provides a new approach for treating genetic disease or mimicking protective alleles, and establishes RNA editing as a useful tool for modifying genetic function.

TABLE 6

| Cas13 ID | Cas13 abbreviation | Host Organism | Protein Accession |
|---|---|---|---|
| Cas13a1 | LshCas13a | *Leptotrichia shahii* | WP_018451595.1 |
| Cas13a2 | LwaCas13a | *Leptotrichia wadei* (Lw2) | WP_021746774.1 |
| Cas13a3 | LseCas13a | *Listeria seeligeri* | WP_012985477.1 |
| Cas13a4 | LbmCas13a | *Lachnospiraceae bacterium* MA2020 | WP_044921188.1 |
| Cas13a5 | LbnCas13a | *Lachnospiraceae bacterium* NK4A179 | WP_022785443.1 |
| Cas13a6 | CamCas13a | [*Clostridium*] *aminophilum* DSM 10710 | WP_031473346.1 |
| Cas13a7 | CgaCas13a | *Carnobacterium gallinarum* DSM 4847 | WP_034560163.1 |
| Cas13a8 | Cga2Cas13a | *Carnobacterium gallinarum* DSM 4847 | WP_034563842.1 |
| Cas13a9 | Pprcas13a | *Paludibacter propionicigenes* WB4 | WP_013443710.1 |
| Cas13a10 | LweCas13a | *Listeria weihenstephanensis* FSL R9-0317 | WP_036059185.1 |
| Cas13a11 | LbfCas13a | *Listeriaceae bacterium* FSL M6-0635 | WP_036091002.1 |
| Cas13a12 | Lwa2Cas13a | *Leptotrichia wadei* F0279 | WP_021746774.1 |
| Cas13a13 | RcsCas13a | *Rhodobacter capsulatus* SB 1003 | WP_013067728.1 |
| Cas13a14 | RcrCas13a | *Rhodobacter capsulatus* R121 | WP_023911507.1 |
| Cas13a15 | RcdCas13a | *Rhodobacter capsulatus* DE442 | WP_023911507.1 |
| Cas13a16 | LbuCas13a | *Leptotrichia buccalis* C-1013-b | WP_015770004.1 |
| Cas13a17 | HheCas13a | *Herbinix hemicellulosilytica* | CRZ35554.1 |
| Cas13a18 | EreCas13a | [*Eubacterium*] *rectale* | WP_055061018.1 |
| Cas13a19 | EbaCas13a | *Eubacteriaceae bacterium* CHKCI004 | WP_090127496.1 |
| Cas13a20 | BmaCas13a | *Blautia* sp. Marseille-P2398 | WP_062808098.1 |
| Cas13a21 | LspCas13a | *Leptotrichia* sp. oral taxon 879 str. F0557 | WP_021744063.1 |
| Cas13b1 | BzoCas13b | *Bergeyella zoohelcum* | WP_002664492 |
| Cas13b2 | PinCas13b | *Prevotella intermedia* | WP_036860899 |
| Cas13b3 | PbuCas13b | *Prevotella buccae* | WP_004343973 |
| Cas13b4 | AspCas13b | *Alistipes* sp. ZOR0009 | WP_047447901 |
| Cas13b5 | PsmCas13b | *Prevotella* sp. MA2016 | WP_036929175 |
| Cas13b6 | RanCas13b | *Riemerella anatipestifer* | WP_004919755 |
| Cas13b7 | PauCas13b | *Prevotella aurantiaca* | WP_025000926 |
| Cas13b8 | PsaCas13b | *Prevotella saccharolytica* | WP_051522484 |
| Cas13b9 | Pin2Cas13b | *Prevotella intermedia* | WP_061868553 |
| Cas13b10 | CcaCas13b | *Capnocytophaga canimorsus* | WP_013997271 |
| Cas13b11 | PguCas13b | *Porphyromonas gulae* | WP_039434803 |
| Cas13b12 | PspCas13b | *Prevotella* sp. P5-125 | WP_044065294 |
| Cas13b13 | FbrCas13b | *Flavobacterium branchiophilum* | WP_014084666 |
| Cas13b14 | PgiCas13b | *Porphyromonas gingivalis* | WP_053444417 |
| Cas13b15 | Pin3Cas13b | *Prevotella intermedia* | WP_050955369 |
| Cas13c1 | FnsCas13c | *Fusobacterium necrophorum* subsp. *funduliforme* ATCC 51357 contig00003 | WP_005959231.1 |
| Cas13c2 | FndCas13c | *Fusobacterium necrophorum* DJ-2 contig0065, whole genome shotgun sequence | WP_035906563.1 |
| Cas13c3 | FnbCas13c | *Fusobacterium necrophorum* BFTR-1 contig0068 | WP_035935671.1 |
| Cas13c4 | FnfCas13c | *Fusobacterium necrophorum* subsp. *funduliforme* 1_1_36S cont1.14 | EHO19081.1 |
| Cas13c5 | FpeCas13c | *Fusobacterium perfoetens* ATCC 29250 T364DRAFT_scaffold00009.9_C | WP_027128616.1 |
| Cas13c6 | FulCas13c | *Fusobacterium ulcerans* ATCC 49185 cont2.38 | WP_040490876.1 |
| Cas13c7 | AspCas13c | *Anaerosalibacter* sp. ND1 genome assembly *Anaerosalibacter massiliensis* ND1 | WP_042678931.1 |

TABLE 7

PFS cutoffs in bacterial screens

| Cas13b ortholog | Key | −Log$_2$ depletion score used to generate PFS motif |
|---|---|---|
| *Bergeyella zoohelcum* | 1 | 2 |
| *Prevotella intermedia* locus 1 | 2 | 1 |
| *Prevotella buccae* | 3 | 3 |
| *Alistipes* sp. ZOR0009 | 4 | 1 |
| *Prevotella* sp. MA2016 | 5 | 2 |
| *Riemerella anatipestifer* | 6 | 4 |
| *Prevotella aurantiaca* | 7 | 1 |
| *Prevotella saccharolytica* | 8 | 0 |
| *Prevotella intermedia* locus 2 | 9 | 0 |
| *Capnocytophaga canimorsus* | 10 | 3 |
| *Porphyromonas gulae* | 11 | 4 |
| *Prevotella* sp. P5-125 | 12 | 2.1 |
| *Flavobacterium branchiophilum* | 13 | 1 |
| *Porphyromonas gingivalis* | 14 | 3 |
| *Prevotella intermedia* locus 2 | 15 | 4 |

TABLE 8 dCas13b-ADAR linker sequences used in this study for RNA editing in mammalian cells.

| FIG. | linker |
|---|---|
| 50C | GSGGGGS (SEQ ID No.: 296) |
| 50E | GS |
| 57B | GSGGGGS (SEQ ID No.: 296) |
| 57C | GS |
| 57D | GS |
| 57E: GS | GS |
| 57E: GSGGGGS | GSGGGGS |
| 57E: (GGGS)3 | GGGGSGGGGSGGGGS (SEQ ID No.: 802) |
| 57E: Rigid | EAAAK (SEQ ID No.: 803) |
| 57E: (GGS)6 | GGSGGSGGSGGSGGSGGS (SEQ ID No.: 804) |
| 57E: XTEN | SGSETPGTSESATPES (SEQ ID No.: 805) |
| 51B | GS |
| 57F | GS |
| 51C | GS |
| 52B | GS |
| 52D | GS |
| 52E | GS |
| 51A: Δ984-1090, Δ1026-1090, Δ1053-1090 | GS |
| 51A: Δ1-125, Δ1-88, Δ1-72 | GSGGGGS |
| 53B | GS |
| 53C | GS |
| 53D | GS |
| 60A | GS |
| 60C | GS |
| 60D | GS |
| 61D | GS |
| 54A | GS |
| 62A | GS |
| 54B | GS |
| 62B | GS |
| 62C | GS |
| 63A | GS |
| 63B | GS |
| 54C | GS |
| 54D | GS |
| 54E | GS |
| 54F | GS |
| 66A | GS |
| 66A | GS |

TABLE 9

Disease information for disease-relevant mutations

| | Gene | Disease |
|---|---|---|
| Full length candidates | | |
| NM_000054.4(AVPR2): c.878G > A (p.Trp293Ter) | AVPR2 | Nephrogenic diabetes insipidus, X-linked |
| NM_000136.2(FANCC): c.1517G > A (p.Trp506Ter) | FANCC | Fanconi anemia, complementation group C |
| Additional simulated candiates Candidate | | |
| NM_000206.2(IL2RG): c.710G > A (p.Trp237Ter) | IL2RG | X-linked severe combined immunodeficiency |
| NM_000132.3(F8): c.3144G > A (p.Trp1048Ter) | F8 | Hereditary factor VIII deficiency disease |
| NM_000527.4(LDLR): c.1449G > A (p.Trp483Ter) | LDLR | Familial hypercholesterolemia |
| NM_000071.2(CBS): c.162G > A (p.Trp54Ter) | CBS | Homocystinuria due to CBS deficiency |
| NM_000518.4(HBB): c.114G > A (p.Trp38Ter) | HBB | beta^0^ Thalassemia\|beta Thalassemia |
| NM_000035.3(ALDOB): c.888G > A (p.Trp296Ter) | ALDOB | Hereditary fructosuria |
| NM_004006.2(DMD): c.3747G > A (p.Trp1249Ter) | DMD | Duchenne muscular dystrophy |
| NM_005359.5(SMAD4): c.906G > A (p.Trp302Ter) | SMAD4 | Juvenile polyposis syndrome |
| NM_000059.3(BRCA2): c.582G > A (p.Trp194Ter) | BRCA2 | Familial cancer of breast\|Breast-ovarian cancer, familial 2 |
| NM_000833.4(GRIN2A): c.3813G > A (p.Trp1271Ter) | GRIN2A | Epilepsy, focal, with speech disorder and with or without mental retardation |

TABLE 9-continued

Disease information for disease-relevant mutations

| | Gene | Disease |
|---|---|---|
| NM_002977.3(SCN9A): c.2691G > A (p.Trp897Ter) | SCN9A | Indifference to pain, congenital, autosomal recessive |
| NM_007375.3(TARDBP): c.943G > A (p.Ala315Thr) | TARDBP | Amyotrophic lateral sclerosis type 10 |
| NM_000492.3(CFTR): c.3846G > A (p.Trp1282Ter) | CFTR | Cystic fibrosis\|Hereditary pancreatitis\|not provided\|ataluren response - Efficacy |
| NM_130838.1(UBE3A): c.2304G > A (p.Trp768Ter) | UBE3A | Angelman syndrome |
| NM_000543.4(SMPD1): c.168G > A (p.Trp56Ter) | SMPD1 | Niemann-Pick disease, type A |
| NM_206933.2(USH2A): c.9390G > A (p.Trp3130Ter) | USH2A | Usher syndrome, type 2A |
| NM_130799.2(MEN1): c.1269G > A (p.Trp423Ter) | MEN1 | Hereditary cancer-predisposing syndrome |
| NM_177965.3(C8orf37): c.555G > A (p.Trp185Ter) | C8orf37 | Retinitis pigmentosa 64 |
| NM_000249.3(MLH1): c.1998G > A (p.Trp666Ter) | MLH1 | Lynch syndrome |
| NM_000548.4(TSC2): c.2108G > A (p.Trp703Ter) | TSC2 | Tuberous sclerosis 2\|Tuberous sclerosis syndrome |
| NM_000267.3(NF1): c.7044G > A (p.Trp2348Ter) | NF1 | Neurofibromatosis, type 1 |
| NM_000179.2(MSH6): c.3020G > A (p.Trp1007Ter) | MSH6 | Lynch syndrome |
| NM_000344.3(SMN1): c.305G > A (p.Trp102Ter) | SMN1 | Spinal muscular atrophy, type II\|Kugelberg-Welander disease |
| NM_024577.3(SH3TC2): c.920G > A (p.Trp307Ter) | SH3TC2 | Charcot-Marie-Tooth disease, type 4C |
| NM_001369.2(DNAH5): c.8465G > A (p.Trp2822Ter) | DNAH5 | Primary ciliary dyskinesia |
| NM_004992.3(MECP2): c.311 G > A (p.Trp104Ter) | MECP2 | Rett syndrome |
| NM_032119.3(ADGRV1): c.7406G > A (p.Trp2469Ter) | ADGRV1 | Usher syndrome, type 2C |
| NM_017651.4(AHI1): c.2174G > A (p.Trp725Ter) | AHI1 | Joubert syndrome 3 |
| NM_004562.2(PRKN): c.1358G > A (p.Trp453Ter) | PRKN | Parkinson disease 2 |
| NM_000090.3(COL3A1): c.3833G > A (p.Trp1278Ter) | COL3A1 | Ehlers-Danlos syndrome, type 4 |
| NM_007294.3(BRCA1): c.5511G > A (p.Trp1837Ter) | BRCA1 | Familial cancer of breast\|Breast-ovarian cancer, familial 1 |
| NM_000256.3(MYBPC3): c.3293G > A (p.Trp1098Ter) | MYBPC3 | Primary familial hypertrophic cardiomyopathy |
| NM_000038.5(APC): c.1262G > A (p.Trp421Ter) | APC | Familial adenomatous polyposis 1 |
| NM_001204.6(BMPR2): c.893G > A (p.W298*) | BMPR2 | Primary pulmonary hypertension |

TABLE 10

Key plasmids used in this study

| Plasmid name | Description |
|---|---|
| pAB0006 | CMV-Cluciferase-polyA EF1a-G-luciferase-polyA |
| pAB0040 | CMV-Cluciferase(STOP85)-polyA EF1a-G-luciferase-polyA |
| pAB0048 | pCDNA-ADAR2-N-terminal B12-HIV NES |
| pAB0050 | pAB0001-A02 (crRNA backbone) |
| pAB0051 | pAB0001-B06 (crRNA backbone) |
| pAB0052 | pAB0001-B11 (crRNA backbone) |
| pAB0053 | pAB0001-B12 (crRNA backbone) |
| pAB0014.B6 | EF1a-BsiWI-Cas13b6-NES-mapk |
| pAB0013.B11 | EF1a-BsiWI-Cas13b11-NES-HIV |
| pAB0013.B12 | EF1a-BsiWI-Cas13b12-NES-HIV |
| pAB0051 | pAB0001-B06 (crRNA backbone) |
| pAB0052 | pAB0001-B11 (crRNA backbone) |
| pAB0053 | pAB0001-B12 (crRNA backbone) |
| pAB0079 | pCDNA-ADAR1hu-EQmutant-N-terminal destination vector |
| pAB0085 | pCDNA-ADAR2 (E488Q)hu-EQmutant-N-terminal destination vector |
| pAB0095 | EF1a-BsiWI-Cas13-B12-NES-HIV, with double H HEPN mutant |
| pAB0114 | pCDNA-wtADAR2hu-EQmutant-N-terminal destination vector |
| pAB0120 | Luciferase ADAR guide optimal (guide 24 from wC0054) |
| pAB0122 | pAB0001-B12 NT guide for ADAR experiments |
| pAB0151 | pCDNA-ADAR2hu-EQmutant-N-terminal destination vector C-term delta 984-1090 |
| pAB0180 | T375G specificity mutant |
| pAB0181 | T375G Cas13b C-term delta 984-1090 |

TABLE 11

Guide/shRNA sequences used in this study for knockdown in mammalian cells

Figure 49E:
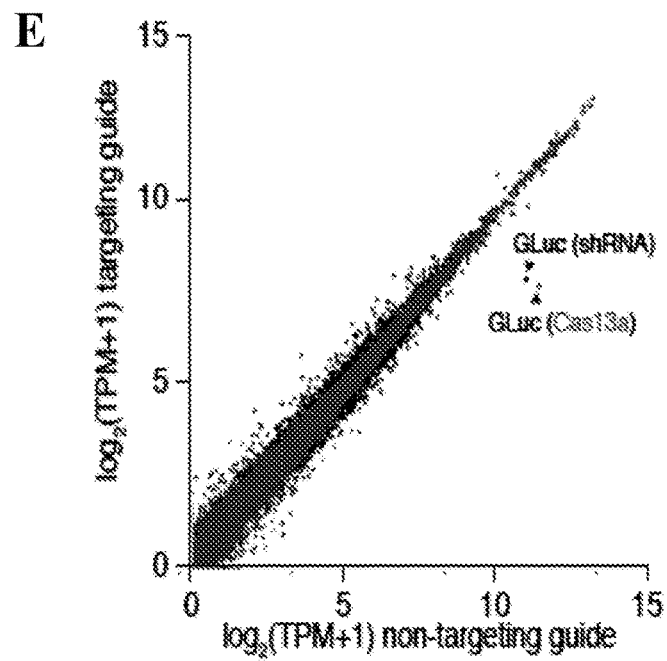

| Name | Spacer sequence | Interference Mechanism | Notes | First FIG. |
|---|---|---|---|---|
| Bacterial PFS guide | GCCAGCUUUCCGGGCAUUGGCUUCCAUC (SEQ ID No. 300) | Cas13b | Used for all orthologs | |
| Cas13a-Gluc guide 1 | GCCAGCTTTCCGGGCATTGGCTTCCATC (SEQ ID No. 301) | Cas13a | Used for all Cas13a orthologs | FIG. 49B |
| Cas13a-Gluc guide 2 | ACCCAGGAATCTCAGGAATGTCGACGAT (SEQ ID No. 302) | Cas13a | Used for all Cas13a orthologs | FIG. 49B |
| Cas13a-non-targeting guide (LacZ) | AGGGTTTTCCCAGTCACGACGTTGTAAA (SEQ ID No. 303) | Cas13a | Used for all Cas13a orthologs | FIG. 49B |
| Cas13b-Gluc guide 1.1 | GGGCAUUGGCUUCCAUCUCUUUGAGCACCT (SEQ ID No. 304) | Cas13b | Used for orthologs 1-3, 6, 7, 10, 11, 12, 14, 15 | FIG. 49B |
| Cas13b-Gluc guide 1.2 | GUGCAGCCAGCUUUCCGGGCAUUGGCUUCC (SEQ ID No. 305) | Cas13b | Used for ortholog 4 | FIG. 49B |
| Cas13b-Gluc guide 1.3 | GCAGCCAGCUUUCCGGGCAUUGGCUUCCAU (SEQ ID No. 306) | Cas13b | Used for ortholog 5 | FIG. 49B |
| Cas13b-Gluc guide 1.4 | GGCUUCCAUCUCUUUGAGCACCUCCAGCGG (SEQ ID No. 307) | Cas13b | Used for ortholog 8, 9 | FIG. 49B |
| Cas13b-Gluc guide 1.5 | GGAAUGUCGACGAUCGCCUCGCCUAUGCCG (SEQ ID No. 308) | Cas13b | Used for ortholog 13 | FIG. 49B |
| Cas13b-Gluc guide 2.1 | GAAUGUCGACGAUCGCCUCGCCUAUGCCGC (SEQ ID No. 309) | Cas13b | Used for orthologs 1-3, 6, 7, 10, 11, 14, 15 | FIG. 49B |
| Cas13b-Gluc guide 2.2 | GACCUGUGCGAUGAACUGCUCCAUGGGCUC (SEQ ID No. 310) | Cas13b | Used for ortholog 12 | FIG. 49B |
| Cas13b-Gluc guide 2.2 | GUGUGGCAGCGUCCUGGGAUGAACUUCUUC (SEQ ID No. 311) | Cas13b | Used for ortholog 4 | FIG. 49B |
| Cas13b-Gluc guide 2.3 | GUGGCAGCGUCCUGGGAUGAACUUCUUCAU (SEQ ID No. 312) | Cas13b | Used for ortholog 5 | FIG. 49B |
| Cas13b-Gluc guide 2.4 | GCUUCUUGCCGGGCAACUUCCCGCGGUCAG (SEQ ID No. 313) | Cas13b | Used for ortholog 8, 9 | FIG. 49B |
| Cas13b-Gluc guide 2.6 | GCAGGGUUUUCCCAGUCACGACGUUGUAAAA (SEQ ID No. 314) | Cas13b | Used for ortholog 13 | FIG. 49B |
| Cas13b-non targeting guide | GCAGGGUUUUCCCAGUCACGACGUUGUAAAA (SEQ ID No. 315) | Cas13b | Used for all orthologs | FIG. 49B |
| Cas13a-Gluc guide-RNASeq | ACCCAGGAAUCUCAGGAAUGUCGACGAU (SEQ ID No. 316) | Cas13a | | FIG. 49E |

349 350

TABLE 11-continued

Guide/shRNA sequences used in this study
for knockdown in mammalian cells

Figure 49F:
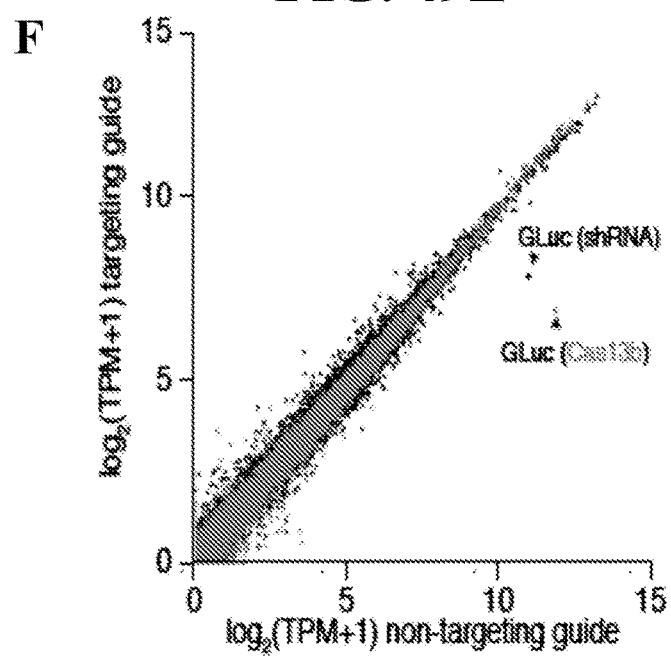
Figure 49G:
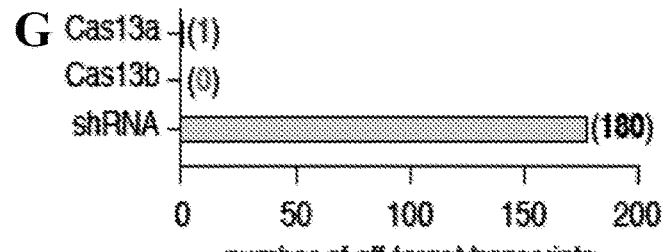

| Name | Spacersequence | Interference Mechanism | Notes | First FIG. |
|---|---|---|---|---|
| shRNA-Gluc guide | CAGCTTTCCGGGCATTGGCTT (SEQ ID No. 317) | shRNA | | FIG. 49F |
| Cas13b-Gluc guide-RNASeq | CCGCUGGAGGUGCUCAAAGAGAUGGAAGCC (SEQ ID No. 318) | Cas13b | | FIG. 49F |
| Cas13a-Gluc-guide-1 | GCCAGCTTTCCGGGCATTGGCTTCCATC (SEQ ID No. 319) | Cas13a | | FIG. 56A |
| Cas13a-Gluc-guide-2 | ACCCAGGAATCTCAGGAATGTCGACGAT (SEQ ID No. 320) | Cas13a | | FIG. 56A |
| Cas13b-Gluc-opt-guide-1 | GGGCATTGGCTTCCATCTCTTTGAGCACCT (SEQ ID No. 321) | Cas13b | | FIG. 56A |
| Cas13b-Gluc-opt-guide-2 | GAAUGUCGACGAUCGCCUCGCCUAUGCCGC (SEQ ID No. 322) | Cas13b | | FIG. 56A |
| Cas13a KRAS guide 1 | CAAGGCACTCTTGCCTACGCCACCAGCT (SEQ ID No. 323) | Cas13a | | FIG. 56B |
| Cas13a KRAS guide 2 | TCATATTCGTCCACAAAATGATTCTGAA (SEQ ID No. 324) | Cas13a | | FIG. 56B |
| Cas13a KRAS guide 3 | ATTATTTATGGCAAATACACAAAGAAAG (SEQ ID No. 325) | Cas13a | | FIG. 56B |
| Cas13a KRAS guide 4 | GAATATCTTCAAATGATTTAGTATTATT (SEQ ID No. 326) | Cas13a | | FIG. 56B |
| Cas13a KRAS guide 5 | ACCATAGGTACATCTTCAGAGTCCTTAA (SEQ ID No. 327) | Cas13a | | FIG. 56B |
| Cas13b KRAS guide 1 | GTCAAGGCACTCTTGCCTACGCCACCAGCT (SEQ ID No. 328) | Cas13b | | FIG. 56B |
| Cas13b KRAS guide 2 | GATCATATTCGTCCACAAAATGATTCTGAA (SEQ ID No. 329) | Cas13b | | FIG. 56B |
| Cas13b KRAS guide 3 | GTATTATTTATGGCAAATACACAAAGAAAG (SEQ ID No. 330) | Cas13b | | FIG. 56B |
| Cas13b KRAS guide 4 | GTGAATATCTTCAAATGATTTAGTATTATT (SEQ ID No. 331) | Cas13b | | FIG. 56B |
| Cas13b KRAS guide 5 | GGACCATAGGTACATCTTCAGAGTCCTTAA (SEQ ID No. 332) | Cas13b | | FIG. 56B |
| shRNA KRAS guide 1 | aagagtgccttgacgatacagcCTCGAG gctgtatcgtcaaggcactctt (SEQ ID No. 333) | shRNA | | FIG. 56B |

TABLE 11-continued

Guide/shRNA sequences used in this study for knockdown in mammalian cells

| Name | Spacersequence | Interference Mechanism | Notes | First FIG. |
|---|---|---|---|---|
| shRNA KRAS guide 2 | aatcattttgtggacgaatatCTCGAGa tattcgtccacaaaatgatt (SEQ ID No. 334) | shRNA | | FIG. 56B |
| shRNA KRAS guide 3 | aaataatactaaatcatttgaCTCGAGt caaatgatttagtattattt (SEQ ID No. 335) | shRNA | | FIG. 56B |
| shRNA KRAS guide 4 | aataatactaaatcatttgaaCTCGAGt tcaaatgatttagtattatt (SEQ ID No. 336) | shRNA | | FIG. 56B |
| shRNA KRAS guide 5 | aaggactctgaagatgtacctCTCGAGa ggtacatcttcagagtcctt (SEQ ID No. 337) | shRNA | | FIG. 56B |

TABLE 12

Guide sequences used for Gluc knockdown

| Name | Spacer sequence | Position | Notes | First FIG. |
|---|---|---|---|---|
| Gluc tiling guide 1 | GAGATCAGGGCAAACAGAACTTTGACTCCC (SEQ ID No. 338) | 2 | Note that the Cas13a spacers are truncated by two nucleotides at the 5' end | 49C |
| Gluc tiling guide 2 | GGATGCAGATCAGGGCAAACAGAACTTTGA (SEQ ID No. 339) | 7 | Note that the Cas13a spacers are truncated by two nucleotides at the 5' end | 49C |
| Gluc tiling guide 3 | GCACAGCGATGCAGATCAGGGCAAACAGAA (SEQ ID No. 340) | 13 | Note that the Cas13a spacers are truncated by two nucleotides at the 5' end | 49C |
| Gluc tiling guide 4 | GCTCGGCCACAGCGATGCAGATCAGGGCAA (SEQ ID No. 341) | 19 | Note that the Cas13a spacers are truncated by two nucleotides at the 5' end | 49C |
| Gluc tiling guide 5 | GGGGCTTGGCCTCGGCCACAGCGATGCAGA (SEQ ID No. 342) | 28 | Note that the Cas13a spacers are truncated by two nucleotides at the 5' end | 49C |
| Gluc tiling | GTGGGCTTGGCCTCGGCCACAGCGATGCAG (SEQ ID No. 343) | 29 | Note that the Cas13a | 49C |

TABLE 12-continued

Guide sequences used for Gluc knockdown

| Name | Spacer sequence | Position | Notes | First FIG. |
|---|---|---|---|---|
| guide 6 | | | spacers are truncated by two nucleotides at the 5' end | |
| Gluc tiling guide 7 | GTCTCGGTGGGCTTGGCCTCGGCCACAGCG (SEQ ID No. 344) | 35 | Note that the Cas13a spacers are truncated by two nucleotides at the 5' end | 49C |
| Gluc tiling guide 8 | GTTCGTTGTTCTCGGTGGGCTTGGCCTCGG (SEQ ID No. 345) | 43 | Note that the Cas13a spacers are truncated by two nucleotides at the 5' end | 49C |
| Gluc tiling guide 9 | GGAAGTCTTCGTTGTTCTCGGTGGGCTTGG (SEQ ID No. 346) | 49 | Note that the Cas13a spacers are truncated by two nucleotides at the 5' end | 49C |
| Gluc tiling guide 10 | GATGTTGAAGTCTTCGTTGTTCTCGGTGGG (SEQ ID No. 347) | 54 | Note that the Cas13a spacers are truncated by two nucleotides at the 5' end | 49C |
| Gluc tiling guide 11 | GCGGCCACGATGTTGAAGTCTTCGTTGTTC (SEQ ID No. 348) | 62 | Note that the Cas13a spacers are truncated by two nucleotides at the 5' end | 49C |
| Gluc tiling guide 12 | GTGGCCACGGCCACGATGTTGAAGTCTTCG (SEQ ID No. 349) | 68 | Note that the Cas13a spacers are truncated by two nucleotides at the 5' end | 49C |
| Gluc tiling guide 13 | GGTTGCTGGCCACGGCCACGATGTTGAAGT (SEQ ID No. 350) | 73 | Note that the Cas13a spacers are truncated by two nucleotides at the 5' end | 49C |
| Gluc tiling guide 14 | GTCGCGAAGTTGCTGGCCACGGCCACGATG (SEQ ID No. 351) | 80 | Note that the Cas13a spacers are truncated by two | 49C |

TABLE 12-continued

Guide sequences used for Gluc knockdown

| Name | Spacer sequence | Position | Notes | First FIG. |
|---|---|---|---|---|
| | | | nucleotides at the 5' end | |
| Gluc tiling guide 15 | GCCGTGGTCGCGAAGTTGCTGGCCACGGCC (SEQ ID No. 352) | 86 | Note that the Cas13a spacers are truncated by two nucleotides at the 5' end | 49C |
| Gluc tiling guide 16 | GCGAGATCCGTGGTCGCGAAGTTGCTGGCC (SEQ ID No. 353) | 92 | Note that the Cas13a spacers are truncated by two nucleotides at the 5' end | 49C |
| Gluc tiling guide 17 | GCAGCATCGAGATCCGTGGTCGCGAAGTTG (SEQ ID No. 354) | 98 | Note that the Cas13a spacers are truncated by two nucleotides at the 5' end | 49C |
| Gluc tiling guide 18 | GGGTCAGCATCGAGATCCGTGGTCGCGAAG (SEQ ID No. 355) | 101 | Note that the Cas13a spacers are truncated by two nucleotides at the 5' end | 49C |
| Gluc tiling guide 19 | GCTTCCCGCGGTCAGCATCGAGATCCGTGG (SEQ ID No. 356) | 109 | Note that the Cas13a spacers are truncated by two nucleotides at the 5' end | 49C |
| Gluc tiling guide 20 | GGGGCAACTTCCCGCGGTCAGCATCGAGAT (SEQ ID No. 357) | 115 | Note that the Cas13a spacers are truncated by two nucleotides at the 5' end | 49C |
| Gluc tiling guide 21 | GTCTTGCCGGGCAACTTCCCGCGGTCAGCA (SEQ ID No. 358) | 122 | Note that the Cas13a spacers are truncated by two nucleotides at the 5' end | 49C |
| Gluc tiling guide 22 | GGCAGCTTCTTGCCGGGCAACTTCCCGCGG (SEQ ID No. 359) | 128 | Note that the Cas13a spacers are truncated by two nucleotides at the 5' end | 49C |

TABLE 12-continued

Guide sequences used for Gluc knockdown

| Name | Spacer sequence | Position | Notes | First FIG. |
|---|---|---|---|---|
| Gluc tiling guide 23 | GCCAGCGGCAGCTTCTTGCCGGGCAACTTC (SEQ ID No. 360) | 134 | Note that the Cas13a spacers are truncated by two nucleotides at the 5' end | 49C |
| Gluc tiling guide 24 | GCACCTCCAGCGGCAGCTTCTTGCCGGGCA (SEQ ID No. 361) | 139 | Note that the Cas13a spacers are truncated by two nucleotides at the 5' end | 49C |
| Gluc tiling guide 25 | GCTTTGAGCACCTCCAGCGGCAGCTTCTTG (SEQ ID No. 362) | 146 | Note that the Cas13a spacers are truncated by two nucleotides at the 5' end | 49C |
| Gluc tiling guide 26 | GCATCTCTTTGAGCACCTCCAGCGGCAGCT (SEQ ID No. 363) | 151 | Note that the Cas13a spacers are truncated by two nucleotides at the 5' end | 49C |
| Gluc tiling guide 27 | GTCCATCTCTTTGAGCACCTCCAGCGGCAG (SEQ ID No. 364) | 153 | Note that the Cas13a spacers are truncated by two nucleotides at the 5' end | 49C |
| Gluc tiling guide 28 | GGGCATTGGCTTCCATCTCTTTGAGCACCT (SEQ ID No. 365) | 163 | Note that the Cas13a spacers are truncated by two nucleotides at the 5' end | 49C |
| Gluc tiling guide 29 | GTCCGGGCATTGGCTTCCATCTCTTTGAGC (SEQ ID No. 366) | 167 | Note that the Cas13a spacers are truncated by two nucleotides at the 5' end | 49C |
| Gluc tiling guide 30 | GGCCAGCTTTCCGGGCATTGGCTTCCATCT (SEQ ID No. 367) | 175 | Note that the Cas13a spacers are truncated by two nucleotides at the 5' end | 49C |
| Gluc tiling | GGGTGCAGCCAGCTTTCCGGGCATTGGCTT (SEQ ID No. 368) | 181 | Note that the Cas13a | 49C |

TABLE 12-continued

Guide sequences used for Gluc knockdown

| Name | Spacer sequence | Position | Notes | First FIG. |
|---|---|---|---|---|
| Gluc tiling guide 31 | | | spacers are truncated by two nucleotides at the 5' end | |
| Gluc tiling guide 32 | GAGCCCCTGGTGCAGCCAGCTTTCCGGGCA (SEQ ID No. 369) | 188 | Note that the Cas13a spacers are truncated by two nucleotides at the 5' end | 49C |
| Gluc tiling guide 33 | GATCAGACAGCCCCTGGTGCAGCCAGCTTT (SEQ ID No. 370) | 195 | Note that the Cas13a spacers are truncated by two nucleotides at the 5' end | 49C |
| Gluc tiling guide 34 | GGCAGATCAGACAGCCCCTGGTGCAGCCAG (SEQ ID No. 371) | 199 | Note that the Cas13a spacers are truncated by two nucleotides at the 5' end | 49C |
| Gluc tiling guide 35 | GACAGGCAGATCAGACAGCCCCTGGTGCAG (SEQ ID No. 372) | 203 | Note that the Cas13a spacers are truncated by two nucleotides at the 5' end | 49C |
| Gluc tiling guide 36 | GTGATGTGGGACAGGCAGATCAGACAGCCC (SEQ ID No. 373) | 212 | Note that the Cas13a spacers are truncated by two nucleotides at the 5' end | 49C |
| Gluc tiling guide 37 | GACTTGATGTGGGACAGGCAGATCAGACAG (SEQ ID No. 374) | 215 | Note that the Cas13a spacers are truncated by two nucleotides at the 5' end | 49C |
| Gluc tiling guide 38 | GGGGCGTGCACTTGATGTGGGACAGGCAGA (SEQ ID No. 375) | 223 | Note that the Cas13a spacers are truncated by two nucleotides at the 5' end | 49C |
| Gluc tiling guide 39 | GCTTCATCTTGGGCGTGCACTTGATGTGGG (SEQ ID No. 376) | 232 | Note that the Cas13a spacers are truncated by two | 49C |

TABLE 12-continued

Guide sequences used for Gluc knockdown

| Name | Spacer sequence | Position | Notes | First FIG. |
|---|---|---|---|---|
| | | | nucleotides at the 5' end | |
| Gluc tiling guide 40 | GTGAACTTCTTCATCTTGGGCGTGCACTTG (SEQ ID No. 377) | 239 | Note that the Cas13a spacers are truncated by two nucleotides at the 5' end | 49C |
| Gluc tiling guide 41 | GGGATGAACTTCTTCATCTTGGGCGTGCAC (SEQ ID No. 378) | 242 | Note that the Cas13a spacers are truncated by two nucleotides at the 5' end | 49C |
| Gluc tiling guide 42 | GTGGGATGAACTTCTTCATCTTGGGCGTGC (SEQ ID No. 379) | 244 | Note that the Cas13a spacers are truncated by two nucleotides at the 5' end | 49C |
| Gluc tiling guide 43 | GGGCAGCGTCCTGGGATGAACTTCTTCATC (SEQ ID No. 380) | 254 | Note that the Cas13a spacers are truncated by two nucleotides at the 5' end | 49C |
| Gluc tiling guide 44 | GGGTGTGGCAGCGTCCTGGGATGAACTTCT (SEQ ID No. 381) | 259 | Note that the Cas13a spacers are truncated by two nucleotides at the 5' end | 49C |
| Gluc tiling guide 45 | GTTCGTAGGTGTGGCAGCGTCCTGGGATGA (SEQ ID No. 382) | 265 | Note that the Cas13a spacers are truncated by two nucleotides at the 5' end | 49C |
| Gluc tiling guide 46 | GCGCCTTCGTAGGTGTGGCAGCGTCCTGGG (SEQ ID No. 383) | 269 | Note that the Cas13a spacers are truncated by two nucleotides at the 5' end | 49C |
| Gluc tiling guide 47 | GTCTTTGTCGCCTTCGTAGGTGTGGCAGCG (SEQ ID No. 384) | 276 | Note that the Cas13a spacers are truncated by two nucleotides at the 5' end | 49C |

TABLE 12-continued

Guide sequences used for Gluc knockdown

| Name | Spacer sequence | Position | Notes | First FIG. |
|---|---|---|---|---|
| Gluc tiling guide 48 | GCTTTGTCGCCTTCGTAGGTGTGGCAGCGT (SEQ ID No. 385) | 275 | Note that the Cas13a spacers are truncated by two nucleotides at the 5' end | 49C |
| Gluc tiling guide 49 | GTGCCGCCCTGTGCGGACTCTTTGTCGCCT (SEQ ID No. 386) | 293 | Note that the Cas13a spacers are truncated by two nucleotides at the 5' end | 49C |
| Gluc tiling guide 50 | GTATGCCGCCCTGTGCGGACTCTTTGTCGC (SEQ ID No. 387) | 295 | Note that the Cas13a spacers are truncated by two nucleotides at the 5' end | 49C |
| Gluc tiling guide 51 | GCCTCGCCTATGCCGCCCTGTGCGGACTCT (SEQ ID No. 388) | 302 | Note that the Cas13a spacers are truncated by two nucleotides at the 5' end | 49C |
| Gluc tiling guide 52 | GGATCGCCTCGCCTATGCCGCCCTGTGCGG (SEQ ID No. 389) | 307 | Note that the Cas13a spacers are truncated by two nucleotides at the 5' end | 49C |
| Gluc tiling guide 53 | GATGTCGACGATCGCCTCGCCTATGCCGCC (SEQ ID No. 390) | 315 | Note that the Cas13a spacers are truncated by two nucleotides at the 5' end | 49C |
| Gluc tiling guide 54 | GCAGGAATGTCGACGATCGCCTCGCCTATG (SEQ ID No. 391) | 320 | Note that the Cas13a spacers are truncated by two nucleotides at the 5' end | 49C |
| Gluc tiling guide 55 | GAATCTCAGGAATGTCGACGATCGCCTCGC (SEQ ID No. 392) | 325 | Note that the Cas13a spacers are truncated by two nucleotides at the 5' end | 49C |
| Gluc tiling | GCCCAGGAATCTCAGGAATGTCGACGATCG (SEQ ID No. 393) | 331 | Note that the Cas13a | 49C |

TABLE 12-continued

Guide sequences used for Gluc knockdown

| Name | Spacer sequence | Position | Notes | First FIG. |
|---|---|---|---|---|
| guide 56 | | | spacers are truncated by two nucleotides at the 5' end | |
| Gluc tiling guide 57 | GCCTTGAACCCAGGAATCTCAGGAATGTCG (SEQ ID No. 394) | 338 | Note that the Cas13a spacers are truncated by two nucleotides at the 5' end | 49C |
| Gluc tiling guide 58 | GCCAAGTCCTTGAACCCAGGAATCTCAGGA (SEQ ID No. 395) | 344 | Note that the Cas13a spacers are truncated by two nucleotides at the 5' end | 49C |
| Gluc tiling guide 59 | GTGGGCTCCAAGTCCTTGAACCCAGGAATC (SEQ ID No. 396) | 350 | Note that the Cas13a spacers are truncated by two nucleotides at the 5' end | 49C |
| Gluc tiling guide 60 | GCCATGGGCTCCAAGTCCTTGAACCCAGGA (SEQ ID No. 397) | 353 | Note that the Cas13a spacers are truncated by two nucleotides at the 5' end | 49C |
| Gluc tiling guide 61 | GGAACTGCTCCATGGGCTCCAAGTCCTTGA (SEQ ID No. 398) | 361 | Note that the Cas13a spacers are truncated by two nucleotides at the 5' end | 49C |
| Gluc tiling guide 62 | GTGCGATGAACTGCTCCATGGGCTCCAAGT (SEQ ID No. 399) | 367 | Note that the Cas13a spacers are truncated by two nucleotides at the 5' end | 49C |
| Gluc tiling guide 63 | GGACCTGTGCGATGAACTGCTCCATGGGCT (SEQ ID No. 400) | 373 | Note that the Cas13a spacers are truncated by two nucleotides at the 5' end | 49C |
| Gluc tiling guide 64 | GACAGATCGACCTGTGCGATGAACTGCTCC (SEQ ID No. 401) | 380 | Note that the Cas13a spacers are truncated by two | 49C |

TABLE 12-continued

Guide sequences used for Gluc knockdown

| Name | Spacer sequence | Position | Notes | First FIG. |
|---|---|---|---|---|
| | | | nucleotides at the 5' end | |
| Gluc tiling guide 65 | GACACACAGATCGACCTGTGCGATGAACTG (SEQ ID No. 402) | 384 | Note that the Cas13a spacers are truncated by two nucleotides at the 5' end | 49C |
| Gluc tiling guide 66 | GTGCAGTCCACACACAGATCGACCTGTGCG (SEQ ID No. 403) | 392 | Note that the Cas13a spacers are truncated by two nucleotides at the 5' end | 49C |
| Gluc tiling guide 67 | GCCAGTTGTGCAGTCCACACACAGATCGAC (SEQ ID No. 404) | 399 | Note that the Cas13a spacers are truncated by two nucleotides at the 5' end | 49C |
| Gluc tiling guide 68 | GGGCAGCCAGTTGTGCAGTCCACACACAGA (SEQ ID No. 405) | 404 | Note that the Cas13a spacers are truncated by two nucleotides at the 5' end | 49C |
| Gluc tiling guide 69 | GTTTGAGGCAGCCAGTTGTGCAGTCCACAC (SEQ ID No. 406) | 409 | Note that the Cas13a spacers are truncated by two nucleotides at the 5' end | 49C |
| Gluc tiling guide 70 | GAAGCCCTTTGAGGCAGCCAGTTGTGCAGT (SEQ ID No. 407) | 415 | Note that the Cas13a spacers are truncated by two nucleotides at the 5' end | 49C |
| Gluc tiling guide 71 | GCACGTTGGCAAGCCCTTTGAGGCAGCCAG (SEQ ID No. 408) | 424 | Note that the Cas13a spacers are truncated by two nucleotides at the 5' end | 49C |
| Gluc tiling guide 72 | GACTGCACGTTGGCAAGCCCTTTGAGGCAG (SEQ ID No. 409) | 428 | Note that the Cas13a spacers are truncated by two nucleotides at the 5' end | 49C |

TABLE 12-continued

Guide sequences used for Gluc knockdown

| Name | Spacer sequence | Position | Notes | First FIG. |
|---|---|---|---|---|
| Gluc tiling guide 73 | GGGTCAGAACACTGCACGTTGGCAAGCCCT (SEQ ID No. 410) | 437 | Note that the Cas13a spacers are truncated by two nucleotides at the 5' end | 49C |
| Gluc tiling guide 74 | GCAGGTCAGAACACTGCACGTTGGCAAGCC (SEQ ID No. 411) | 439 | Note that the Cas13a spacers are truncated by two nucleotides at the 5' end | 49C |
| Gluc tiling guide 75 | GAGCAGGTCAGAACACTGCACGTTGGCAAG (SEQ ID No. 412) | 441 | Note that the Cas13a spacers are truncated by two nucleotides at the 5' end | 49C |
| Gluc tiling guide 76 | GGCCACTTCTTGAGCAGGTCAGAACACTGC (SEQ ID No. 413) | 452 | Note that the Cas13a spacers are truncated by two nucleotides at the 5' end | 49C |
| Gluc tiling guide 77 | GCGGCAGCCACTTCTTGAGCAGGTCAGAAC (SEQ ID No. 414) | 457 | Note that the Cas13a spacers are truncated by two nucleotides at the 5' end | 49C |
| Gluc tiling guide 78 | GTGCGGCAGCCACTICTTGAGCAGO1CAGA (SEQ ID No. 415) | 459 | Note that the Cas13a spacers are truncated by two nucleotides at the 5' end | 49C |
| Gluc tiling guide 79 | GAGCGTTGCGGCAGCCACTTCTTGAGCAGG (SEQ ID No. 416) | 464 | Note that the Cas13a spacers are truncated by two nucleotides at the 5' end | 49C |
| Gluc tiling guide 80 | GAAAGGTCGCACAGCGTTGCGGCAGCCACT (SEQ ID No. 417) | 475 | Note that the Cas13a spacers are truncated by two nucleotides at the 5' end | 49C |
| Gluc tiling | GCTGGCAAAGGTCGCACAGCGTTGCGGCAG (SEQ ID No. 418) | 480 | Note that the Cas13a | 49C |

TABLE 12-continued

Guide sequences used for Gluc knockdown

| Name | Spacer sequence | Position | Notes | First FIG. |
|---|---|---|---|---|
| guide 81 | | | spacers are truncated by two nucleotides at the 5' end | |
| Gluc tiling guide 82 | GGGCAAAGGTCGCACAGCGTTGCGGCAGCC (SEQ ID No. 419) | 478 | Note that the Cas13a spacers are truncated by two nucleotides at the 5' end | 49C |
| Gluc tiling guide 83 | GTGGATCTTGCTGGCAAAGGTCGCACAGCG (SEQ ID No. 420) | 489 | Note that the Cas13a spacers are truncated by two nucleotides at the 5' end | 49C |
| Gluc tiling guide 84 | GCACCTGGCCCTGGATCTTGCTGGCAAAGG (SEQ ID No. 421) | 499 | Note that the Cas13a spacers are truncated by two nucleotides at the 5' end | 49C |
| Gluc tiling guide 85 | GTGGCCCTGGATCTTGCTGGCAAAGGTCGC (SEQ ID No. 422) | 495 | Note that the Cas13a spacers are truncated by two nucleotides at the 5' end | 49C |
| Gluc tiling guide 86 | GTGATCTTGTCCACCTGGCCCTGGATCTTG (SEQ ID No. 423) | 509 | Note that the Cas13a spacers are truncated by two nucleotides at the 5' end | 49C |
| Gluc tiling guide 87 | GCCCCTTGATCTTGTCCACCTGGCCCTGGA (SEQ ID No. 424) | 514 | Note that the Cas13a spacers are truncated by two nucleotides at the 5' end | 49C |
| Gluc tiling guide 88 | GCCCTTGATCTTGTCCACCTGGCCCTGGAT (SEQ ID No. 425) | 513 | Note that the Cas13a spacers are truncated by two nucleotides at the 5' end | 49C |
| Gluc tiling guide 89 | GCCTTGATCTTGTCCACCTGGCCCTGGATC (SEQ ID No. 426) | 512 | Note that the Cas13a spacers are truncated by two | 49C |

TABLE 12-continued

Guide sequences used for Gluc knockdown

| Name | Spacer sequence | Position | Notes | First FIG. |
|---|---|---|---|---|
| | | | nucleotides at the 5' end | |
| Gluc tiling guide 90 | GGCAAAGGTCGCACAGCGTTGCGGCAGCCA (SEQ ID No. 427) | 477 | Note that the Cas13a spacers are truncated by two nucleotides at the 5' end | 49C |
| Gluc tiling guide 91 | GCAAAGGTCGCACAGCGTTGCGGCAGCCAC (SEQ ID No. 428) | 476 | Note that the Cas13a spacers are truncated by two nucleotides at the 5' end | 49C |
| Gluc tiling guide 92 | GAAGGTCGCACAGCGTTGCGGCAGCCACTT (SEQ ID No. 429) | 474 | Note that the Cas13a spacers are truncated by two nucleotides at the 5' end | 49C |
| Gluc tiling guide 93 | GAGGTCGCACAGCGTTGCGGCAGCCACTTC (SEQ ID No. 430) | 473 | Note that the Cas13a spacers are truncated by two nucleotides at the 5' end | 49C |
| Non-targeting guide 1 | GGTAATGCCTGGCTTGTCGACGCATAGTCTG (SEQ ID No. 431) | N/A | Note that the Cas13a spacers are truncated by two nucleotides at the 5' end | 49C |
| Non-targeting guide 2 | GGGAACCTTGGCCGTTATAAAGTCTGACCAG (SEQ ID No. 432) | N/A | Note that the Cas13a spacers are truncated by two nucleotides at the 5' end | 49C |
| Non-targeting guide 3 | GGAGGGTGAGAATTTAGAACCAAGATTGTTG (SEQ ID No. 433) | N/A | Note that the Cas13a spacers are truncated by two nucleotides at the 5' end | 49C |

TABLE 13

Guide sequences used for Cluc knockdown

| Name | Spacer sequence | Position | Notes | First FIG. |
|---|---|---|---|---|
| Cluc tiling guide 1 | GAGTCCTGGCAATGAACAGTGGCGCAGTAG (SEQ ID No. 434) | 32 | Note that the Cas13a spacers are truncated by two nucleotides at the 5' end | 49D |
| Cluc tiling guide 2 | GGGTGCCACAGCTGCTATCAATACATTCTC (SEQ ID No. 435) | 118 | Note that the Cas13a spacers are truncated by two nucleotides at the 5' end | 49D |
| Cluc tiling guide 3 | GTTACATACTGACACATTCGGCAACATGTT (SEQ ID No. 436) | 197 | Note that the Cas13a spacers are truncated by two nucleotides at the 5' end | 49D |
| Cluc tiling guide 4 | GTATGTACCAGGTTCCTGGAACTGGAATCT (SEQ ID No. 437) | 276 | Note that the Cas13a spacers are truncated by two nucleotides at the 5' end | 49D |
| Cluc tiling guide 5 | GCCTTGGTTCCATCCAGGTTCTCCAGGGTG (SEQ ID No. 438) | 350 | Note that the Cas13a spacers are truncated by two nucleotides at the 5' end | 49D |
| Cluc tiling guide 6 | GCAGTGATGGGATTCTCAGTAGCTTGAGCG (SEQ ID No. 439) | 431 | Note that the Cas13a spacers are truncated by two nucleotides at the 5' end | 49D |
| Cluc tiling guide 7 | GAGCCTGGCATCTCAACAACAGCGATGGTG (SEQ ID No. 440) | 512 | Note that the Cas13a spacers are truncated by two nucleotides at the 5' end | 49D |
| Cluc tiling guide 8 | GTGTCTGGGGCGATTCTTACAGATCTTCCT (SEQ ID No. 441) | 593 | Note that the Cas13a spacers are truncated by two nucleotides at the 5' end | 49D |
| Cluc tiling guide 9 | GCTGGATCTGAAGTGAAGTCTGTATCTTCC (SEQ ID No. 442) | 671 | Note that the Cas13a spacers are | 49D |

TABLE 13-continued

Guide sequences used for Cluc knockdown

| Name | Spacer sequence | Position | Notes | First FIG. |
|---|---|---|---|---|
| | | | truncated by two nucleotides at the 5' end | |
| Cluc tiling guide 10 | GGCAACGTCATCAGGATTTCCATAGAGTGG (SEQ ID No. 443) | 747 | Note that the Cas13a spacers are truncated by two nucleotides at the 5' end | 49D |
| Cluc tiling guide 11 | GAGGCGCAGGAGATGGTGTAGTAGTAGAAG (SEQ ID No. 444) | 830 | Note that the Cas13a spacers are truncated by two nucleotides at the 5' end | 49D |
| Cluc tiling guide 13 | GAGGGACCCTGGAATTGGTATCTTGCTTTG (SEQ ID No. 445) | 986 | Note that the Cas13a spacers are truncated by two nucleotides at the 5' end | 49D |
| Cluc tiling guide 14 | GGTAAGAGTCAACATTCCTGTGTGAAACCT (SEQ ID No. 446) | 1066 | Note that the Cas13a spacers are truncated by two nucleotides at the 5' end | 49D |
| Cluc tiling guide 15 | GACCAGAATCTGTTTTCCATCAACAATGAG (SEQ ID No. 447) | 1143 | Note that the Cas13a spacers are truncated by two nucleotides at the 5' end | 49D |
| Cluc tiling guide 16 | GATGGCTGTAGTCAGTATGTCACCATCTTG (SEQ ID No. 448) | 1227 | Note that the Cas13a spacers are truncated by two nucleotides at the 5' end | 49D |
| Cluc tiling guide 17 | GTACCATCGAATGGATCTCTAATATGTACG (SEQ ID No. 449) | 1304 | Note that the Cas13a spacers are truncated by two nucleotides at the 5' end | 49D |
| Cluc tiling guide 18 | GAGATCACAGGCTCCTTCAGCATCAAAAGA (SEQ ID No. 450) | 1380 | Note that the Cas13a spacers are truncated by two nucleotides | 49D |

TABLE 13-continued

Guide sequences used for Cluc knockdown

| Name | Spacer sequence | Position | Notes | First FIG. |
|---|---|---|---|---|
| | | | at the 5' end | |
| Cluc tiling guide 19 | GCTTTGACCGGCGAAGAGACTATTGCAGAG (SEQ ID No. 451) | 1461 | Note that the Cas13a spacers are truncated by two nucleotides at the 5' end | 49D |
| Cluc tiling guide 20 | GCCCCTCAGGCAATACTCGTACATGCATCG (SEQ ID No. 452) | 1539 | Note that the Cas13a spacers are truncated by two nucleotides at the 5' end | 49D |
| Cluc tiling guide 21 | GCTGGTACTTCTAGGGTGTCTCCATGCTTT (SEQ ID No. 453) | 1619 | Note that the Cas13a spacers are truncated by two nucleotides at the 5' end | 49D |
| Non-targeting guide 1 | GGTAATGCCTGGCTTGTCGACGCATAGTCTG (SEQ ID No. 454) | N/A | Note that the Cas13a spacers are truncated by two nucleotides at the 5' end | 49D |
| Non-targeting guide 2 | GGGAACCTTGGCCGTTATAAAGTCTGACCAG (SEQ ID No. 455) | N/A | Note that the Cas13a spacers are truncated by two nucleotides at the 5' end | 49D |
| Non-targeting guide 3 | GGAGGGTGAGAATTTAGAACCAAGATTGTTG (SEQ ID No. 456) | N/A | Note that the Cas13a spacers are truncated by two nucleotides at the 5' end | 49D |

TABLE 14

Guide sequences used in this study for RNA editing in mammalian cells. Mismatched base flips are capitalized

| Name | Spacer sequence | Notes | First FIG. |
|---|---|---|---|
| Tiling 30 nt 30 mismatch distance | gCatcctgcggcctctactctgcattcaatt (SEQ ID No. 457) | Has a 5' G for U6 expression | 50C |
| Tiling 30 nt 28 mismatch distance | gacCatcctgcggcctctactctgcattcaa (SEQ ID No. 458) | Has a 5' G for U6 expression | 50C |

TABLE 14-continued

Guide sequences used in this study for RNA editing in mammalian cells. Mismatched base flips are capitalized

| Name | Spacer sequence | Notes | First FIG. |
|---|---|---|---|
| Tiling 30 nt 26 mismatch distance | gaaacCatcctgcggcctctactctgcattc (SEQ ID No. 459) | Has a 5' G for U6 expression | 50C |
| Tiling 30 nt 24 mismatch distance | gctaaacCatcctgcggcctctactctgcat (SEQ ID No. 460) | Has a 5' G for U6 expression | 50C |
| Tiling 30 nt 22 mismatch distance | gttctaaacCatcctgcggcctctactctgc (SEQ ID No. 461) | Has a 5' G for U6 expression | 50C |
| Tiling 30 nt 20 mismatch distance | gtgttctaaacCatcctgcggcctctactct (SEQ ID No. 462) | Has a 5' G for U6 expression | 50C |
| Tiling 30 nt 18 mismatch distance | gaatgttctaaacCatcctgcggcctctact (SEQ ID No. 463) | Has a 5' G for U6 expression | 50C |
| Tiling 30 nt 16 mismatch distance | gagaatgttctaaacCatcctgcggcctcta (SEQ ID No. 464) | Has a 5' G for U6 expression | 50C |
| Tiling 30 nt 14 mismatch distance | gatagaatgttctaaacCatcctgcggcctc (SEQ ID No. 465) | Has a 5' G for U6 expression | 50C |
| Tiling 30 nt 12 mismatch distance | gccatagaatgttctaaacCatcctgcggcc (SEQ ID No. 466) | Has a 5' G for U6 expression | 50C |
| Tiling 30 nt 10 mismatch distance | gttccatagaatgttctaaacCatcctgcgg (SEQ ID No. 467) | Has a 5' G for U6 expression | 50C |
| Tiling 30 nt 8 mismatch distance | gattccatagaatgttctaaacCatcctgc (SEQ ID No. 468) | Has a 5' G for U6 expression | 50C |
| Tiling 30 nt 6 mismatch distance | gctattccatagaatgttctaaacCatcct (SEQ ID No. 469) | Has a 5' G for U6 expression | 50C |
| Tiling 30 nt 4 mismatch distance | gatctattccatagaatgttctaaacCatc (SEQ ID No. 470) | Has a 5' G for U6 expression | 50C |
| Tiling 30 nt 2 mismatch distance | ggaatctattccatagaatgttctaaacCa (SEQ ID No. 471) | Has a 5' G for U6 expression | 50C |
| Tiling 50 nt 50 mismatch distance | gCatcctgcggcctctactctgcattcaattacatactgacacattcggca (SEQ ID No. 472) | Has a 5' G for U6 expression | 50C |
| Tiling 50 nt 48 mismatch distance | gacCatcctgcggcctctactctgcattcaattacatactgacacattcgg (SEQ ID No. 473) | Has a 5' G for U6 expression | 50C |
| Tiling 50 nt 46 mismatch distance | gaaacCatcctgcggcctctactctgcattcaattacatactgacacattc (SEQ ID No. 474) | Has a 5' G for U6 expression | 50C |
| Tiling 50 nt 44 mismatch distance | gctaaacCatcctgcggcctctactctgcattcaattacatactgacacat (SEQ ID No. 475) | Has a 5' G for U6 expression | 50C |
| Tiling 50 nt 42 mismatch distance | gttctaaacCatcctgcggcctctactctgcattcaattacatactgacac (SEQ ID No. 476) | Has a 5' G for U6 expression | 50C |
| Tiling 50 nt 40 mismatch distance | gtgttctaaacCatcctgcggcctctactctgcattcaattacatactgac (SEQ ID No. 477) | Has a 5' G for U6 expression | 50C |
| Tiling 50 nt 38 mismatch distance | gaatgttctaaacCatcctgcggcctctactctgcattcaattacatactg (SEQ ID No. 478) | Has a 5' G for U6 expression | 50C |
| Tiling 50 nt 36 mismatch distance | gagaatgttctaaacCatcctgcggcctctactctgcattcaattacatac (SEQ ID No. 479) | Has a 5' G for U6 expression | 50C |

TABLE 14-continued

Guide sequences used in this study for RNA editing in
mammalian cells. Mismatched base flips are capitalized

| Name | Spacer sequence | Notes | First FIG. |
|---|---|---|---|
| Tiling 50 nt 34 mismatch distance | gatagaatgttctaaacCatcctgcggcctc tactctgcattcaattacat(SEQ ID No. 480) | Has a 5' G for U6 expression | 50C |
| Tiling 50 nt 32 mismatch distance | gccatagaatgttctaaacCatcctgcggcc tctactctgcattcaattac(SEQ ID No. 481) | Has a 5' G for U6 expression | 50C |
| Tiling 50 nt 30 mismatch distance | gttccatagaatgttctaaacCatcctgcgg cctctactctgcattcaatt(SEQ ID No. 482) | Has a 5' G for U6 expression | 50C |
| Tiling 50 nt 28 mismatch distance | gattccatagaatgttctaaacCatcctgcg gcctctactctgcattcaa(SEQ ID No. 483) | Has a 5' G for U6 expression | 50C |
| Tiling 50 nt 26 mismatch distance | gctattccatagaatgttctaaacCatcctg cggcctctactctgcattc(SEQ ID No. 484) | Has a 5' G for U6 expression | 50C |
| Tiling 50 nt 24 mismatch distance | gatctattccatagaatgttctaaacCatcc tgcggcctctactctgcat(SEQ ID No. 485) | Has a 5' G for U6 expression | 50C |
| Tiling 50 nt 22 mismatch distance | ggaatctattccatagaatgttctaaacCat cctgcggcctctactctgc(SEQ ID No. 486) | Has a 5' G for U6 expression | 50C |
| Tiling 50 nt 20 mismatch distance | gtggaatctattccatagaatgttctaaacC atcctgcggcctctactct(SEQ ID No. 487) | Has a 5' G for U6 expression | 50C |
| Tiling 50 nt 18 mismatch distance | gactggaatctattccatagaatgttctaaa cCatcctgcggcctctact(SEQ ID No. 488) | Has a 5' G for U6 expression | 50C |
| Tiling 50 nt 16 mismatch distance | ggaactggaatctctttccatagaatgttct aaacCatcctgcggcctcta(SEQ ID No. 489) | Has a 5' G for U6 expression | 50C |
| Tiling 50 nt 14 mismatch distance | gtggaactggaatctctttccatagaatgtt ctaaacCatcctgcggcctc(SEQ ID No. 490) | Has a 5' G for U6 expression | 50C |
| Tiling 50 nt 12 mismatch distance | gcctggaactggaatctctttccatagaatg ttctaaacCatcctgcggcc(SEQ ID No. 491) | Has a 5' G for U6 expression | 50C |
| Tiling 50 nt 10 mismatch distance | gttcctggaactggaatctctttccatagaa tgttctaaacCatcctgcgg(SEQ ID No. 492) | Has a 5' G for U6 expression | 50C |
| Tiling 50 nt 8 mismatch distance | gggttcctggaactggaatctctttccatag aatgttctaaacCatcctgc(SEQ ID No. 493) | Has a 5' G for U6 expression | 50C |
| Tiling 50 nt 6 mismatch distance | gcaggttcctggaactggaatctctttccat agaatgttctaaacCatcct(SEQ ID No. 494) | Has a 5' G for U6 expression | 50C |
| Tiling 50 nt 4 mismatch distance | gaccaggttcctggaactggaatctctttcc atagaatgttctaaacCatc(SEQ ID No. 495) | Has a 5' G for U6 expression | 50C |
| Tiling 50 nt 2 mismatch distance | ggtaccaggttcctggaactggaatctcttt ccatagaatgttctaaacCa(SEQ ID No. 496) | Has a 5' G for U6 expression | 50C |
| Tiling 70 nt 70 mismatch distance | gCatcctgcggcctctactctgcattcaatt acatactgacacattcggcaacatgttttc ctggtttat(SEQ ID No. 497) | Has a 5' G for U6 expression | 50C |

TABLE 14-continued

Guide sequences used in this study for RNA editing in mammalian cells. Mismatched base flips are capitalized

| Name | Spacer sequence | Notes | First FIG. |
|------|-----------------|-------|------------|
| Tiling 70 nt 68 mismatch distance | gacCatcctgcggcctctactctgcattcaa ttacatactgacacattcggcaacatgtttt tcctggttt(SEQ ID No. 498) | Has a 5' G for U6 expression | 50C |
| Tiling 70 nt 66 mismatch distance | gaaacCatcctgcggcctctactctgcattc aattacatactgacacattcggcaacatgtt tttcctggt(SEQ ID No. 499) | Has a 5' G for U6 expression | 50C |
| Tiling 70 nt 64 mismatch distance | gctaaacCatcctgcggcctctactctgcat tcaattacatactgacacattcggcaacatg tttttcctg(SEQ ID No. 500) | Has a 5' G for U6 expression | 50C |
| Tiling 70 nt 62 mismatch distance | gttctaaacCatcctgcggcctctactctgc attcaattacatactgacacattcggcaaca tgttttcc(SEQ ID No. 501) | Has a 5' G for U6 expression | 50C |
| Tiling 70 nt 60 mismatch distance | gtgttctaaacCatcctgcggcctctactct gcattcaattacatactgacacattcggcaa catgtttt(SEQ ID No. 502) | Has a 5' G for U6 expression | 50C |
| Tiling 70 nt 58 mismatch distance | gaatgttctaaacCatcctgcggcctctact ctgcattcaattacatactgacacattcggc aacatgttt(SEQ ID No. 503) | Has a 5' G for U6 expression | 50C |
| Tiling 70 nt 56 mismatch distance | gagaatgttctaaacCatcctgcggcctcta ctctgcattcaattacatactgacacattcg gcaacatgt(SEQ ID No. 504) | Has a 5' G for U6 expression | 50C |
| Tiling 70 nt 54 mismatch distance | gatagaatgttctaaacCatcctgcggcctc tactctgcattcaattacatactgacacatt cggcaacat(SEQ ID No. 505) | Has a 5' G for U6 expression | 50C |
| Tiling 70 nt 52 mismatch distance | gccatagaatgttctaaacCatcctgcggcc tctactctgcattcaattacatactgacaca ttcggcaac(SEQ ID No. 506) | Has a 5' G for U6 expression | 50C |
| Tiling 70 nt 50 mismatch distance | gttccatagaatgttctaaacCatcctgcgg cctctactctgcattcaattacatactgaca cattcggca(SEQ ID No. 507) | Has a 5' G for U6 expression | 50C |
| Tiling 70 nt 48 mismatch distance | gattccatagaatgttctaaacCatcctgcg gcctctactctgcattcaattacatactgac acattcgg(SEQ ID No. 508) | Has a 5' G for U6 expression | 50C |
| Tiling 70 nt 46 mismatch distance | gctattccatagaatgttctaaacCatcctg cggcctctactctgcattcaattacatactg acacattc(SEQ ID No. 509) | Has a 5' G for U6 expression | 50C |
| Tiling 70 nt 44 mismatch distance | gatctattccatagaatgttctaaacCatcc tgcggcctctactctgcattcaattacatac tgacacat(SEQ ID No. 510) | Has a 5' G for U6 expression | 50C |
| Tiling 70 nt 42 mismatch distance | ggaatctattccatagaatgttctaaacCat cctgcggcctctactctgcattcaattacat actgacac(SEQ ID No. 511) | Has a 5' G for U6 expression | 50C |
| Tiling 70 nt 40 mismatch distance | gtggaatctattccatagaatgttctaaacC atcctgcggcctctactctgcattcaattac atactgac(SEQ ID No. 512) | Has a 5' G for U6 expression | 50C |
| Tiling 70 nt 38 mismatch distance | gactggaatctattccatagaatgttctaaa cCatcctgcggcctctactctgcattcaatt acatactg(SEQ ID No. 513) | Has a 5' G for U6 expression | 50C |
| Tiling 70 nt 36 mismatch distance | ggaactggaatctctttccatagaatgttct aaacCatcctgcggcctctactctgcattca attacatac(SEQ ID No. 514) | Has a 5' G for U6 expression | 50C |
| Tiling 70 nt 34 mismatch distance | gtggaactggaatctctttccatagaatgtt ctaaacCatcctgcggcctctactctgcatt caattacat(SEQ ID No. 515) | Has a 5' G for U6 expression | 50C |

TABLE 14-continued

Guide sequences used in this study for RNA editing in mammalian cells. Mismatched base flips are capitalized

| Name | Spacer sequence | Notes | First FIG. |
|---|---|---|---|
| Tiling 70 nt 32 mismatch distance | gcctggaactggaatctctttccatagaatg ttctaaaacCatcctgcggcctctactctgca ttcaattac(SEQ ID No. 516) | Has a 5' G for U6 expression | 50C |
| Tiling 70 nt 30 mismatch distance | gttcctggaactggaatctctttccatagaa tgttctaaaacCatcctgcggcctctactctg cattcaatt(SEQ ID No. 517) | Has a 5' G for U6 expression | 50C |
| Tiling 70 nt 28 mismatch distance | gggttcctggaactggaatctctttccatag aatgttctaaaacCatcctgcggcctctactc tgcattcaa(SEQ ID No. 518) | Has a 5' G for U6 expression | 50C |
| Tiling 70 nt 26 mismatch distance | gcaggttcctggaactggaatctctttccat agaatgttctaaaacCatcctgcggcctctac tctgcattc(SEQ ID No. 519) | Has a 5' G for U6 expression | 50C |
| Tiling 70 nt 24 mismatch distance | gaccaggttcctggaactggaatctctttcc atagaatgttctaaaacCatcctgcggcctct actctgcat(SEQ ID No. 520) | Has a 5' G for U6 expression | 50C |
| Tiling 70 nt 22 mismatch distance | ggtaccaggttcctggaactggaatctcttt ccatagaatgttctaaaacCatcctgcggcct ctactctgc(SEQ ID No. 521) | Has a 5' G for U6 expression | 50C |
| Tiling 70 nt 20 mismatch distance | gatgtaccaggttcctggaactggaatctct ttccatagaatgttctaaaacCatcctgcggc ctctactct(SEQ ID No. 522) | Has a 5' G for U6 expression | 50C |
| Tiling 70 nt 18 mismatch distance | ggtatgtaccaggttcctggaactggaatct ctttccatagaatgttctaaaacCatcctgcg gcctctact(SEQ ID No. 523) | Has a 5' G for U6 expression | 50C |
| Tiling 70 nt 16 mismatch distance | gacgtatgtaccaggttcctggaactggaat ctattccatagaatgttctaaaacCatcctgc ggcctcta(SEQ ID No. 524) | Has a 5' G for U6 expression | 50C |
| Tiling 70 nt 14 mismatch distance | gacacgtatgtaccaggttcctggaactgga atctattccatagaatgttctaaaacCatcct gcggcctc(SEQ ID No. 525) | Has a 5' G for U6 expression | 50C |
| Tiling 70 nt 12 mismatch distance | gcaacacgtatgtaccaggttcctggaactg gaatctattccatagaatgttctaaaacCatc ctgcggcc(SEQ ID No. 526) | Has a 5' G for U6 expression | 50C |
| Tiling 70 nt 10 mismatch distance | gcccaacacgtatgtaccaggttcctggaac tggaatctattccatagaatgttctaaaacCa tcctgcgg(SEQ ID No. 527) | Has a 5' G for U6 expression | 50C |
| Tiling 70 nt 8 mismatch distance | ggacccaacacgtatgtaccaggttcctgga actggaatctattccatagaatgttctaaac Catcctgc(SEQ ID No. 528) | Has a 5' G for U6 expression | 50C |
| Tiling 70 nt 6 mismatch distance | gttgacccaacacgtatgtaccaggttcctg gaactggaatctattccatagaatgttctaa acCatcct(SEQ ID No. 529) | Has a 5' G for U6 expression | 50C |
| Tiling 70 nt 4 mismatch distance | gccttgacccaacacgtatgtaccaggttcc tggaactggaatctctttccatagaatgttc taaacCatc(SEQ ID No. 530) | Has a 5' G for U6 expression | 50C |
| Tiling 70 nt 2 mismatch distance | gttccttgacccaacacgtatgtaccaggtt cctggaactggaatctctttccatagaatgt tctaaacCa(SEQ ID No. 531) | Has a 5' G for U6 expression | 50C |
| Tiling 84 nt 84 mismatch distance | gCatcctgcggcctctactctgcattcaatt acatactgacacattcggcaacatgttttc ctggtttattttcacacagtcca(SEQ ID No. 532) | Has a 5' G for U6 expression | 50C |
| Tiling 84 nt 82 mismatch distance | gacCatcctgcggcctctactctgcattcaa ttacatactgacacattcggcaacatgtttt tcctggtttattttcacacagtc(SEQ ID No. 533) | Has a 5' G for U6 expression | 50C |

TABLE 14-continued

Guide sequences used in this study for RNA editing in mammalian cells. Mismatched base flips are capitalized

| Name | Spacer sequence | Notes | First FIG. |
|---|---|---|---|
| Tiling 84 nt 80 mismatch distance | gaaacCatcctgcggcctctactctgcattc aattacatactgacacattcggcaacatgtt tttcctggtttattttcacacag(SEQ ID No. 534) | Has a 5' G for U6 expression | 50C |
| Tiling 84 nt 78 mismatch distance | gctaaacCatcctgcggcctctactctgcat tcaattacatactgacacattcggcaacatg tttttcctggtttattttcacac(SEQ ID No. 535) | Has a 5' G for U6 expression | 50C |
| Tiling 84 nt 76 mismatch distance | gttctaaacCatcctgcggcctctactctgc attcaattacatactgacacattcggcaaca tgttttcctggtttattttcac(SEQ ID No. 536) | Has a 5' G for U6 expression | 50C |
| Tiling 84 nt 74 mismatch distance | gtgttctaaacCatcctgcggcctctactct gcattcaattacatactgacacattcggcaa catgttttcctggtttattttc(SEQ ID No. 537) | Has a 5' G for U6 expression | 50C |
| Tiling 84 nt 72 mismatch distance | gaatgttctaaacCatcctgcggcctctact ctgcattcaattacatactgacacattcggc aacatgttttcctggtttattt(SEQ ID No. 538) | Has a 5' G for U6 expression | 50C |
| Tiling 84 nt 70 mismatch distance | gagaatgttctaaacCatcctgcgcctcta ctctgcattcaattacatactgacacattcg gcaacatgttttcctggtttat(SEQ ID No. 539) | Has a 5' G for U6 expression | 50C |
| Tiling 84 nt 68 mismatch distance | gatagaatgttctaaacCatcctgcggcctc tactctgcattcaattacatactgacacatt cggcaacatgttttcctggttt(SEQ ID No. 540) | Has a 5' G for U6 expression | 50C |
| Tiling 84 nt 66 mismatch distance | gccatagaatgttctaaacCatcctgcggcc tctactctgcattcaattacatactgacaca ttcggcaacatgttttcctggt(SEQ ID No. 541) | Has a 5' G for U6 expression | 50C |
| Tiling 84 nt 64 mismatch distance | gttccatagaatgttctaaacCatcctgcgg cctctactctgcattcaattacatactgaca cattcggcaacatgttttcctg(SEQ ID No. 542) | Has a 5' G for U6 expression | 50C |
| Tiling 84 nt 62 mismatch distance | gattccatagaatgttctaaacCatcctgcg gcctctactctgcattcaattacatactgac acattcggcaacatgttttcc(SEQ ID No. 543) | Has a 5' G for U6 expression | 50C |
| Tiling 84 nt 60 mismatch distance | gctattccatagaatgttctaaacCatcctg cggcctctactctgcattcaattacatactg acacattcggcaacatgttttt(SEQ ID No. 544) | Has a 5' G for U6 expression | 50C |
| Tiling 84 nt 58 mismatch distance | gatctattccatagaatgttctaaacCatcc tgcggcctctactctgcattcaattacatac tgacacattcggcaacatgttt(SEQ ID No. 545) | Has a 5' G for U6 expression | 50C |
| Tiling 84 nt 56 mismatch distance | ggaatctattccatagaatgttctaaacCat cctgcggcctctactctgcattcaattacat actgacacattcggcaacatgt(SEQ ID No. 546) | Has a 5' G for U6 expression | 50C |
| Tiling 84 nt 54 mismatch distance | gtggaatctattccatagaatgttctaaacC atcctgcggcctctactctgcattcaattac atactgacacattcggcaacat(SEQ ID No. 547) | Has a 5' G for U6 expression | 50C |

TABLE 14-continued

Guide sequences used in this study for RNA editing in mammalian cells. Mismatched base flips are capitalized

| Name | Spacer sequence | Notes | First FIG. |
|---|---|---|---|
| Tiling 84 nt 52 mismatch distance | gactggaatctattccatagaatgttctaaa cCatcctgcggcctctactctgcattcaatt acatactgacacattcggcaac(SEQ ID No. 548) | Has a 5' G for U6 expression | 50C |
| Tiling 84 nt 50 mismatch distance | ggaactggaatctctttccatagaatgttct aaacCatcctgcggcctctactctgcattca attacatactgacacattcggca(SEQ ID No. 549) | Has a 5' G for U6 expression | 50C |
| Tiling 84 nt 48 mismatch distance | gtggaactggaatctctttccatagaatgtt ctaaacCatcctgcggcctctactctgcatt caattacatactgacacattcgg(SEQ ID No. 550) | Has a 5' G for U6 expression | 50C |
| Tiling 84 nt 46 mismatch distance | gcctggaactggaatctctttccatagaatg ttctaaacCatcctgcggcctctactctgca ttcaattacatactgacacattc(SEQ ID No. 551) | Has a 5' G for U6 expression | 50C |
| Tiling 84 nt 44 mismatch distance | gttcctggaactggaatctctttccatagaa tgttctaaacCatcctgcggcctctactctg cattcaattacatactgacacat(SEQ ID No. 552) | Has a 5' G for U6 expression | 50C |
| Tiling 84 nt 42 mismatch distance | gggttcctggaactggaatctctttccatag aatgttctaaacCatcctgcggcctctactc tgcattcaattacatactgacac(SEQ ID No. 553) | Has a 5' G for U6 expression | 50C |
| Tiling 84 nt 40 mismatch distance | gcaggttcctggaactggaatctctttccat agaatgttctaaacCatcctgcggcctctac tctgcattcaattacatactgac(SEQ ID No. 554) | Has a 5' G for U6 expression | 50C |
| Tiling 84 nt 38 mismatch distance | gaccaggttcctggaactggaatctctttcc atagaatgttctaaacCatcctgcggcctct actctgcattcaattacatactg(SEQ ID No. 555) | Has a 5' G for U6 expression | 50C |
| Tiling 84 nt 36 mismatch distance | ggtaccaggttcctggaactggaatctcttt ccatagaatgttctaaacCatcctgcggcct ctactctgcattcaattacatac(SEQ ID No. 556) | Has a 5' G for U6 expression | 50C |
| Tiling 84 nt 34 mismatch distance | gatgtaccaggttcctggaactggaatctct ttccatagaatgttctaaacCatcctgcggc ctctactctgcattcaattacat(SEQ ID No. 557) | Has a 5' G for U6 expression | 50C |
| Tiling 84 nt 32 mismatch distance | ggtatgtaccaggttcctggaactggaatct ctttccatagaatgttctaaacCatcctgcg gcctctactctgcattcaattac(SEQ ID No. 558) | Has a 5' G for U6 expression | 50C |
| Tiling 84 nt 30 mismatch distance | gacgtatgtaccaggttcctggaactggaat ctattccatagaatgttctaaacCatcctgc ggcctctactctgcattcaatt(SEQ ID No. 559) | Has a 5' G for U6 expression | 50C |
| Tiling 84 nt 28 mismatch distance | gacacgtatgtaccaggttcctggaactgga atctattccatagaatgttctaaacCatcct gcggcctctactctgcattcaa(SEQ ID No. 560) | Has a 5' G for U6 expression | 50C |
| Tiling 84 nt 26 mismatch distance | gcaacacgtatgtaccaggttcctggaactg gaatctattccatagaatgttctaaacCatc ctgcggcctctactctgcattc(SEQ ID No. 561) | Has a 5' G for U6 expression | 50C |

TABLE 14-continued

Guide sequences used in this study for RNA editing in mammalian cells. Mismatched base flips are capitalized

| Name | Spacer sequence | Notes | First FIG. |
|---|---|---|---|
| Tiling 84 nt 24 mismatch distance | gcccaacacgtatgtaccaggttcctggaac tggaatctattccatagaatgttctaaacCa tcctgcggcctctactctgcat(SEQ ID No. 562) | Has a 5' G for U6 expression | 50C |
| Tiling 84 nt 22 mismatch distance | ggacccaacacgtatgtaccaggttcctgga actggaatctattccatagaatgttctaaac Catcctgcggcctctactctgc(SEQ ID No. 563) | Has a 5' G for U6 expression | 50C |
| Tiling 84 nt 20 mismatch distance | gttgacccaacacgtatgtaccaggttcctg gaactggaatctattccatagaatgttctaa acCatcctgcggcctctactct(SEQ ID No. 564) | Has a 5' G for U6 expression | 50C |
| Tiling 84 nt 18 mismatch distance | gccttgacccaacacgtatgtaccaggttcc tggaactggaatctctttccatagaatgttc taaacCatcctgcggcctctact(SEQ ID No. 565) | Has a 5' G for U6 expression | 50C |
| Tiling 84 nt 16 mismatch distance | gttccttgacccaacacgtatgtaccaggtt cctggaactggaatctctttccatagaatgt tctaaacCatcctgcggcctcta(SEQ ID No. 566) | Has a 5' G for U6 expression | 50C |
| Tiling 84 nt 14 mismatch distance | gggttccttgacccaacacgtatgtaccagg ttcctggaactggaatctctttccatagaat gttctaaacCatcctgcggcctc(SEQ ID No. 567) | Has a 5' G for U6 expression | 50C |
| Tiling 84 nt 12 mismatch distance | gttggttccttgacccaacacgtatgtacca ggttcctggaactggaatctctttccataga atgttctaaacCatcctgcggcc(SEQ ID No. 568) | Has a 5' G for U6 expression | 50C |
| Tiling 84 nt 10 mismatch distance | gccttggttccttgacccaacacgtatgtac caggttcctggaactggaatctctttccata gaatgttctaaacCatcctgcgg(SEQ ID No. 569) | Has a 5' G for U6 expression | 50C |
| Tiling 84 nt 8 mismatch distance | ggcccttggttccttgacccaacacgtatgt accaggttcctggaactggaatctctttcca tagaatgttctaaacCatcctgc(SEQ ID No. 570) | Has a 5' G for U6 expression | 50C |
| Tiling 84 nt 6 mismatch distance | gccgccttggttccttgacccaacacgtat gtaccaggttcctggaactggaatctctttc catagaatgttctaaacCatcct(SEQ ID No. 571) | Has a 5' G for U6 expression | 50C |
| Tiling 84 nt 4 mismatch distance | gcgccgccttggttccttgacccaacacgt atgtaccaggttcctggaactggaatctctt tccatagaatgttctaaacCatc(SEQ ID No. 572) | Has a 5' G for U6 expression | 50C |
| Tiling 84 nt 2 mismatch distance | ggtcgccgccttggttccttgacccaacac gtatgtaccaggttcctggaactggaatctc tttccatagaatgttctaaacCa(SEQ ID No. 573) | Has a 5' G for U6 expression | 50C |
| ADAR non-targeting guide | GTAATGCCTGGCTTGTCGACGCATAGTCTG (SEQ ID No. 574) | Has a 5' G for U6 expression | 50C |
| PFS binding screen guide for TAG motif | gaaaacgcaggttcctcCagtttgggagca gcgcacgtctccctgtagtc(SEQ ID No. 575) | Has a 5' G for U6 expression | 51B |
| PFS binding screen guide for AAC motif | gacgcaggttcctctagCttcgggagcagcg cacgtctccctgtagtcaag(SEQ ID No. 576) | Has a 5' G for U6 expression | 51B |

TABLE 14-continued

Guide sequences used in this study for RNA editing in mammalian cells. Mismatched base flips are capitalized

| Name | Spacer sequence | Notes | First FIG. |
| --- | --- | --- | --- |
| PFS binding screen non-targeting | GTAATGCCTGGCTTGTCGACGCATAGTCTG (SEQ ID No. 577) | Has a 5' G for U6 expression | 51B |
| Motif preference targeting guide | gatagaatgttctaaacCatcctgcggcctc tactctgcattcaattacat(SEQ ID No. 578) | Has a 5' G for U6 expression | 51C |
| Motif preference non-targeting guide | GTAATGCCTGGCTTGTCGACGCATAGTCTG (SEQ ID No. 579) | Has a 5' G for U6 expression | 51C |
| PPIB tiling guide 50 mismatch distance | gCaaggccacaaaattatccactgtttttgg aacagtctttccgaagagac (SEQ ID No. 580) | Has a 5' G for U6 expression | 57D |
| PPIB tiling guide 42 mismatch distance | gcctgtagcCaaggccacaaaattatccact gtttttggaacagtctttcc(SEQ ID No. 581) | Has a 5' G for U6 expression | 57D |
| PPIB tiling guide 34 mismatch distance | gattctctcctgtagcCaaggccacaaaatt atccactgtttttggaaca(SEQ ID No. 582) | Has a 5' G for U6 expression | 57D |
| PPIB tiling guide 26 mismatch distance | ggccaaatcctttctctcctgtagcCaaggc cacaaaattatccactgttt(SEQ ID No. 583) | Has a 5' G for U6 expression | 57D |
| PPIB tiling guide 18 mismatch distance | gtttttgtagccaaatcctttctctcctgta agcCaggccacaaaattatc(SEQ ID No. 584) | Has a 5' G for U6 expression | 57D |
| PPIB tiling guide 10 mismatch distance | gatttgctgtttttgtagccaaatcctttct ctcctgtagcCaaggccaca(SEQ ID No. 585) | Has a 5' G for U6 expression | 57D |
| PPIB tiling guide 2 mismatch distance | gacgatggaatttgctgtttttgtagccaaa tcctttctctcctgtagcCa(SEQ ID No. 586) | Has a 5' G for U6 expression | 57D |
| Targeting guide, opposite base G | gatagaatgttctaaacGatcctgcggcctc tactctgcattcaattacat(SEQ ID No. 587) | Has a 5' G for U6 expression | 57D |
| Targeting guide, opposite base A | gatagaatgttctaaacAatcctgcggcctc tactctgcattcaattacat(SEQ ID No. 588) | Has a 5' G for U6 expression | 57D |
| Targeting guide, opposite base C | gatagaatgttctaaacTatcctgcggcctc tactctgcattcaattacat(SEQ ID No. 589) | Has a 5' G for U6 expression | 57D |
| AVPR2 guide 37 mismatch distance | ggtcccacgcggccCacagctgcaccaggaa gaagggtgcccagcacagca(SEQ ID No. 590) | Has a 5' G for U6 expression | 52A |
| AVPR2 guide 35 mismatch distance | ggggtcccacgcggccCacagctgcaccagg aagaagggtgcccagcacag(SEQ ID No. 591) | Has a 5' G for U6 expression | 52A |
| AVPR2 guide 33 mismatch distance | gccgggtcccacgcggccCacagctgcacca ggaagaagggtgcccagcac(SEQ ID No. 592) | Has a 5' G for U6 expression | 52A |
| FANCC guide 37 mismatch distance | gggtgatgacatccCaggcgatcgtgtggcc tccaggagcccagagcagga(SEQ ID No. 593) | Has a 5' G for U6 expression | 52B |
| FANCC guide 35 mismatch distance | gagggtgatgacatccCaggcgatcgtgtgg cctccaggagcccagagcag(SEQ ID No. 594) | Has a 5' G for U6 expression | 52B |

TABLE 14-continued

Guide sequences used in this study for RNA editing in mammalian cells. Mismatched base flips are capitalized

| Name | Spacer sequence | Notes | First FIG. |
|---|---|---|---|
| FANCC guide 32 mismatch distance | gatcagggtgatgacatccCaggcgatcgtg tggcctccaggagcccagag(SEQ ID No. 595) | Has a 5' G for U6 expression | 52B |
| Synthetic disease gene target IL2RG | ggtggctccattcactcCaatgctgagcact tccacagagtgggttaaagc(SEQ ID No. 596) | Has a 5' G for U6 expression | 52E |
| Synthetic disease gene target F8 | gtttctaatatattttgCcagactgatggac tattctcaattaataatgat(SEQ ID No. 597) | Has a 5' G for U6 expression | 52E |
| Synthetic disease gene target LDLR | gagatgttgctgtggatCcagtccacagcca gcccgtcggggcctggatg(SEQ ID No. 598) | Has a 5' G for U6 expression | 52E |
| Synthetic disease gene target CBS | gcaggccggcccagctgCcaggtgcacctgc tcggagcatcgggccggatc(SEQ ID No. 599) | Has a 5' G for U6 expression | 52E |
| Synthetic disease gene target HBB | gcaaagaacctctgggtCcaagggtagacca ccagcagcctgcccagggcc(SEQ ID No. 600) | Has a 5' G for U6 expression | 52E |
| Synthetic disease gene target ALDOB | gaagagaaacttagtttCcagggattggtag agggcaaaggttgatagca(SEQ ID No. 601) | Has a 5' G for U6 expression | 52E |
| Synthetic disease gene target DMD | gtcagcctagtgcagagCcactggtagttgg tggttagagtttcaagttcc(SEQ ID No. 602) | Has a 5' G for U6 expression | 52E |
| Synthetic disease gene target SMAD4 | ggctcattgtgaacaggCcagtaatgtccgg gatgggcggcataggcggg(SEQ ID No. 603) | Has a 5' G for U6 expression | 52E |
| Synthetic disease gene target BRCA2 | gtagctaaagaacttgaCcaagacatatcag gatccacctcagctcctaga(SEQ ID No. 604) | Has a 5' G for U6 expression | 52E |
| Synthetic disease gene target GRIN2A | ggggcattgttctgtgcCcagtcctgctggt agacctgctccccggtggct(SEQ ID No. 605) | Has a 5' G for U6 expression | 52E |
| Synthetic disease gene target SCN9A | gagaagtcgttcatgtgCcaccgtgggagcg tacagtcatcattgatcttg(SEQ ID No. 606) | Has a 5' G for U6 expression | 52E |
| Synthetic disease gene target TARDBP | gggattaatgctgaacgCaccaaagttcatc ccaccacccatattactacc(SEQ ID No. 607) | Has a 5' G for U6 expression | 52E |
| Synthetic disease gene target CFTR | gctccaaaggattectCcactgttgcaaagt tattgaatcccaagacaca(SEQ ID No. 608) | Has a 5' G for U6 expression | 52E |
| Synthetic disease gene target UBE3A | gatgaatgaacgatttcCcagaactccctaa tcagaacagagtccctggta(SEQ ID No. 609) | Has a 5' G for U6 expression | 52E |
| Synthetic disease gene target SMPD1 | ggagcctctgccggagcCcagagaacccgag agtcagacagagccagcgcc(SEQ ID No. 610) | Has a 5' G for U6 expression | 52E |
| Synthetic disease gene target USH2A | ggatccgtggagacacCcaatcaatttgaag agatcttgaagtgatgcca(SEQ ID No. 611) | Has a 5' G for U6 expression | 52E |
| Synthetic disease gene target MEN1 | gtgggactgccctectcCcatttgcagatgc cgtcgtagaatcgcagcagg(SEQ ID No. 612) | Has a 5' G for U6 expression | 52E |

TABLE 14-continued

Guide sequences used in this study for RNA editing in mammalian cells. Mismatched base flips are capitalized

| Name | Spacer sequence | Notes | First FIG. |
|---|---|---|---|
| Synthetic disease gene target C8orf37 | gatatcaatagttctCcagctacactggcag gcatatgcccgtgttcct (SEQ ID No. 613) | Has a 5' G for U6 expression | 52E |
| Synthetic disease gene target MLH1 | gattectificttcgtcCcaattcacctcag tggctagtcgaagaatgaag (SEQ ID No. 614) | Has a 5' G for U6 expression | 52E |
| Synthetic disease gene target TSC2 | gcagatcagcaccttcCagtcagactectgc ttcaagcactgcagcagga (SEQ ID No. 615) | Has a 5' G for U6 expression | 52E |
| Synthetic disease gene target NF1 | gccatttgatgcagtgCcactccagaggatt ccggattgccataaatact (SEQ ID No. 616) | Has a 5' G for U6 expression | 52E |
| Synthetic disease gene target MSH6 | gttcaatagttttggtcCagtatcgtttaca gcccttcttggtagatttca (SEQ ID No. 617) | Has a 5' G for U6 expression | 52E |
| Synthetic disease gene target SMN1 | ggcaaccgtatctgacCaaatggcagaacat ttgtccccaactttccact (SEQ ID No. 618) | Has a 5' G for U6 expression | 52E |
| Synthetic disease gene target SH3TC2 | gcgacttccaatgaacCactgaagcccagg tatgacaaagccgatgatct (SEQ ID No. 619) | Has a 5' G for U6 expression | 52E |
| Synthetic disease gene target DNAH5 | gtttacactcatgatcCacagattaacagat catttggttccttgatga (SEQ ID No. 620) | Has a 5' G for U6 expression | 52E |
| Synthetic disease gene target MECP2 | gataagatccgtgtcCagccttcaggcaggg tggggtcatcatacatgg (SEQ ID No. 621) | Has a 5' G for U6 expression | 52E |
| Synthetic disease gene target ADGRV1 | ggacagctgggctgatcCatgatgtcatcca gaaacactggggaccctcag (SEQ ID No. 622) | Has a 5' G for U6 expression | 52E |
| Synthetic disease gene target AHI1 | gtctcatctcaactttcCatatccgtatcat ggaatcatagcatcctgtaa (SEQ ID No. 623) | Has a 5' G for U6 expression | 52E |
| Synthetic disease gene target PRKN | gcatgcagacgcggttcCactcgcagccaca gttccagcaccactcgagcc (SEQ ID No. 624) | Has a 5' G for U6 expression | 52E |
| Synthetic disease gene target COL3A1 | gttggttagggtcaaccCagtattctccact atgagttcaggatggcaga (SEQ ID No. 625) | Has a 5' G for U6 expression | 52E |
| Synthetic disease gene target BRCA1 | gctacactgtccaacacCcactctcgggtca ccacaggtgcctcacacatc (SEQ ID No. 626) | Has a 5' G for U6 expression | 52E |
| Synthetic disease gene target MYBPC3 | gctgcactgtgtaccccCagagctccgtgtt gccgacatcctgggtggct (SEQ ID No. 627) | Has a 5' G for U6 expression | 52E |
| Synthetic disease gene target APC | gagatcctgccactccCaacaggtttcacag taagcgcgtatctgttcca (SEQ ID No. 628) | Has a 5' G for U6 expression | 52E |
| Synthetic disease gene target BMPR2 | gacggcaagagcttaccCagtcacttgtgtg gagacttaaatacttgcata (SEQ ID No. 629) | Has a 5' G for U6 expression | 52E |
| KRAS tiling guide 50 mismatch distance | gCaaggccacaaaattatccactgttttgg aacagtctttccgaagagac (SEQ ID No. 630) | Has a 5' G for U6 expression | 53A |

TABLE 14-continued

Guide sequences used in this study for RNA editing in mammalian cells. Mismatched base flips are capitalized

| Name | Spacer sequence | Notes | First FIG. |
|---|---|---|---|
| KRAS tiling guide 42 mismatch distance | gcctgtagcCaaggccacaaaattatccact gtttttggaacagtctttcc(SEQ ID No. 631) | Has a 5' G for U6 expression | 53A |
| KRAS tiling guide 34 mismatch distance | gattctctectgtagcCaaggccacaaaatt atccactgtttttggaaca(SEQ ID No. 632) | Has a 5' G for U6 expression | 53A |
| KRAS tiling guide 26 mismatch distance | ggccaaatcctttctcctgtagcCaaggc cacaaaattatccactgttt(SEQ ID No. 633) | Has a 5' G for U6 expression | 53A |
| KRAS tiling guide 18 mismatch distance | gtttttgtagccaaatcctttctctcctgta gcCaaggccacaaaattatc(SEQ ID No. 634) | Has a 5' G for U6 expression | 53A |
| KRAS tiling guide 10 mismatch distance | gatttgctgtttttgtagccaaatcctttct ctcctgtagcCaaggccaca(SEQ ID No. 635) | Has a 5' G for U6 expression | 53A |
| KRAS tiling guide 2 mismatch distance | gacgatggaatttgctgtttttgtagccaaa tcctttctctectgtagcCa(SEQ ID No. 636) | Has a 5' G for U6 expression | 53A |
| KRAS tiling non-targeting guide | GTAATGCCTGGCTTGTCGACGCATAGTCTG (SEQ ID No. 637) | Has a 5' G for U6 expression | 53A |
| Luciferase W85X targeting guide for transcriptome specificity | gatagaatgttctaaacCatcctgcggcctc tactctgcattcaattacat(SEQ ID No. 638) | Has a 5' G for U6 expression | 53B |
| Non-targeting guide for transcriptome specificity | GCAGGGTTTTCCCAGTCACGACGTTGTAAAG TTG(SEQ ID No. 639) | Has a 5' G for U6 expression | 53C |
| endogenous KRAS guide 2 | gtcaaggcactcttgccCacgccaccagctc caactaccacaagtttatat(SEQ ID No. 640) | Has a 5' G for U6 expression | 54F |
| endogenous PPIB guide 1 | gcaaagatcacccggccCacatcttcatctc caattcgtaggtcaaaatac(SEQ ID No. 641) | Has a 5' G for U6 expression | 54G |
| endogenous KRAS guide 1 | GcgccaccagctccaacCaccacaagtttat attcagtcattttcagcagg(SEQ ID No. 642) | Has a 5' G for U6 expression | 54F |
| endogenous KRAS guide 3 | GffictccatcaattacCacttgatcctgta ggaatcctctattGTtgga(SEQ ID No. 643) | Has a 5' G for U6 expression | 54F |
| endogenous PPIB guide 2 | GattctctectgtagcCaaggccacaaaatt atccactgtttttggaaca(SEQ ID No. 644) | Has a 5' G for U6 expression | 54G |
| endogenous non-targeting guide | GTAATGCCTGGCTTGTCGACGCATAGTCTG (SEQ ID No. 645) | Has a 5' G for U6 expression | 54F |
| BoxB Clue guide | tattccataGGCCCTGAAAAAGGGCCtgttc taaacCatcctgcggcctctactcGGCCCTG AAAAAGGGCCattcaattac(SEQ ID No. 646) | Has a 5' G for U6 expression | 62B |
| BoxB non-targeting guide | cagctggcgaGGCCCTGAAAAAGGGCCgggg atgtgcCgcaaggcgattaagttggGGCCCT GAAAAGGGCCacgccagggt(SEQ ID No. 647) | Has a 5' G for U6 expression | 62B |
| Stafforst full length ADAR2 guide | GTGGAATAGTATAACAATATGCTAAATGTTG 1TTATAGTATCCCACTctaaaCCAtcctgcgg GGCCCTCTTCAGGGCCC(SEQ ID No. 648) | Has a 5' G for U6 expression | 62C |

TABLE 14-continued

Guide sequences used in this study for RNA editing in mammalian cells. Mismatched base flips are capitalized

| Name | Spacer sequence | Notes | First FIG. |
|---|---|---|---|
| Stafforst full length ADAR2 non-targeting guide | GTGGAATAGTATAACAATATGCTAAATGTTG TTATAGTATCCCACaccctggcgttacccaG GCCCTCTTCAGGGCCC(SEQ ID No. 649) | Has a 5' G for U6 expression | 62C |

REFERENCES

1. P. D. Hsu, E. S. Lander, F. Zhang, Development and applications of CRISPR-Cas9 for genome engineering. Cell 157, 1262-1278 (2014).
2. A. C. Komor, A. H. Badran, D. R. Liu, CRISPR-Based Technologies for the Manipulation of Eukaryotic Genomes. Cell 168, 20-36 (2017).
3. L. Cong et al., Multiplex genome engineering using CRISPR/Cas systems. Science 339, 819-823 (2013).
4. P. Mali et al., RNA-guided human genome engineering via Cas9. Science 339, 823-826 (2013).
5. B. Zetsche et al., Cpf1 is a single RNA-guided endonuclease of a class 2 CRISPR-Cas system. Cell 163, 759-771 (2015).
6. H. Kim, J. S. Kim, A guide to genome engineering with programmable nucleases. Nat Rev Genet 15, 321-334 (2014).
7. A. C. Komor, Y. B. Kim, M. S. Packer, J. A. Zuris, D. R. Liu, Programmable editing of a target base in genomic DNA without double-stranded DNA cleavage. Nature 533, 420-424 (2016).
8. K. Nishida et al., Targeted nucleotide editing using hybrid prokaryotic and vertebrate adaptive immune systems. Science 353, (2016).
9. Y. B. Kim et al., Increasing the genome-targeting scope and precision of base editing with engineered Cas9-cytidine deaminase fusions. Nat Biotechnol 35, 371-376 (2017).
10. O. O. Abudayyeh et al., C2c2 is a single-component programmable RNA-guided RNA-targeting CRISPR effector. Science 353, aaf5573 (2016).
11. S. Shmakov et al., Discovery and Functional Characterization of Diverse Class 2 CRISPR-Cas Systems. Mol Cell 60, 385-397 (2015).
12. S. Shmakov et al., Diversity and evolution of class 2 CRISPR-Cas systems. Nat Rev Microbiol 15, 169-182 (2017).
13. A. A. Smargon et al., Cas13b Is a Type VI-B CRISPR-Associated RNA-Guided RNase Differentially Regulated by Accessory Proteins Csx27 and Csx28. Mol Cell 65, 618-630 e617 (2017).
14. J. S. Gootenberg et al., Nucleic acid detection with CRISPR-Cas13a/C2c2. Science 356, 438-442 (2017).
15. O. O. Abudayyeh et al., RNA targeting with CRISPR-Cas13a. Nature in press, (2017).
16. K. Nishikura, Functions and regulation of RNA editing by ADAR deaminases. Annu Rev Biochem 79, 321-349 (2010).
17. B. L. Bass, H. Weintraub, An unwinding activity that covalently modifies its double-stranded RNA substrate. Cell 55, 1089-1098 (1988).
18. M. M. Matthews et al., Structures of human ADAR2 bound to dsRNA reveal base-flipping mechanism and basis for site selectivity. Nat Struct Mol Biol 23, 426-433 (2016).
19. A. Kuttan, B. L. Bass, Mechanistic insights into editing-site specificity of ADARs. Proc Natl Acad Sci USA 109, E3295-3304 (2012).
20. S. K. Wong, S. Sato, D. W. Lazinski, Substrate recognition by ADAR1 and ADAR2. RNA 7, 846-858 (2001).
21. M. Fukuda et al., Construction of a guide-RNA for site-directed RNA mutagenesis utilising intracellular A-to-I RNA editing. Sci Rep 7, 41478 (2017).
22. M. F. Montiel-Gonzalez, I. Vallecillo-Viejo, G. A. Yudowski, J. J. Rosenthal, Correction of mutations within the cystic fibrosis transmembrane conductance regulator by site-directed RNA editing. Proc Natl Acad Sci USA 110, 18285-18290 (2013).
23. M. F. Montiel-Gonzalez, I. C. Vallecillo-Viejo, J. J. Rosenthal, An efficient system for selectively altering genetic information within mRNAs. Nucleic Acids Res 44, e157 (2016).
24. J. Wettengel, P. Reautschnig, S. Geisler, P. J. Kahle, T. Stafforst, Harnessing human ADAR2 for RNA repair—Recoding a PINK1 mutation rescues mitophagy. Nucleic Acids Res 45, 2797-2808 (2017).
25. Y. Wang, J. Havel, P. A. Beal, A Phenotypic Screen for Functional Mutants of Human Adenosine Deaminase Acting on RNA 1. ACS Chem Biol 10, 2512-2519 (2015).
26. K. A. Lehmann, B. L. Bass, Double-stranded RNA adenosine deaminases ADAR1 and ADAR2 have overlapping specificities. Biochemistry 39, 12875-12884 (2000).
27. Y. Zheng, C. Lorenzo, P. A. Beal, DNA editing in DNA/RNA hybrids by adenosine deaminases that act on RNA. Nucleic Acids Res 45, 3369-3377 (2017).
28. K. Gao et al., A de novo loss-of-function GRIN2A mutation associated with childhood focal epilepsy and acquired epileptic aphasia. PLoS One 12, e0170818 (2017).
29. H. M. Lanoiselee et al., APP, PSEN1, and PSEN2 mutations in early-onset Alzheimer disease: A genetic screening study of familial and sporadic cases. PLoS Med 14, e1002270 (2017).
30. C. Ballatore, V. M. Lee, J. Q. Trojanowski, Tau-mediated neurodegeneration in Alzheimer's disease and related disorders. Nat Rev Neurosci 8, 663-672 (2007).
31. Y. Li et al., Carriers of rare missense variants in IFIH1 are protected from psoriasis. J Invest Dermatol 130, 2768-2772 (2010).
32. R. S. Finkel et al., Treatment of infantile-onset spinal muscular atrophy with nusinersen: a phase 2, open-label, dose-escalation study. Lancet 388, 3017-3026 (2016).

Example 4

Mutations in ADAR affecting ADAR activity were screened using yeast screening. The screen was performed in multiple rounds. Each round of screening yielded a set of candidate mutations. The candidate mutations were then validated in mammalian cells. The top-performing mutations were added to the last version of mutations and re-screened. The mutations screened in 8 rounds are shown in the table below. The mutant identified in round n was designated as "RESCUE vn." As discussed herein RESCUE refer to mutations that convert adenosine deaminase activity to cytidine deaminase activity.

| RESCUE Round | ADAR mutations | Plasmid number |
|---|---|---|
| RESCUEv0 | E488Q | pAB0048 |
| RESCUEv1 | E488Q, V351G | |
| RESCUEv2 | E488Q, V351G, S486A | |
| RESCUEv3 | E488Q, V351G, S486A, T375S | pAB0642 |
| RESCUEv4 | E488Q, V351G, S486A, T375S, S370C | pAB1072 |
| RESCUEv5 | E488Q, V351G, S486A, T375S, S370C, P462A | pAB1135 |
| RESCUEv6 | E488Q, V351G, S486A, T375S, S370C, P462A, N597I | pAB1146 |

Figure 69:
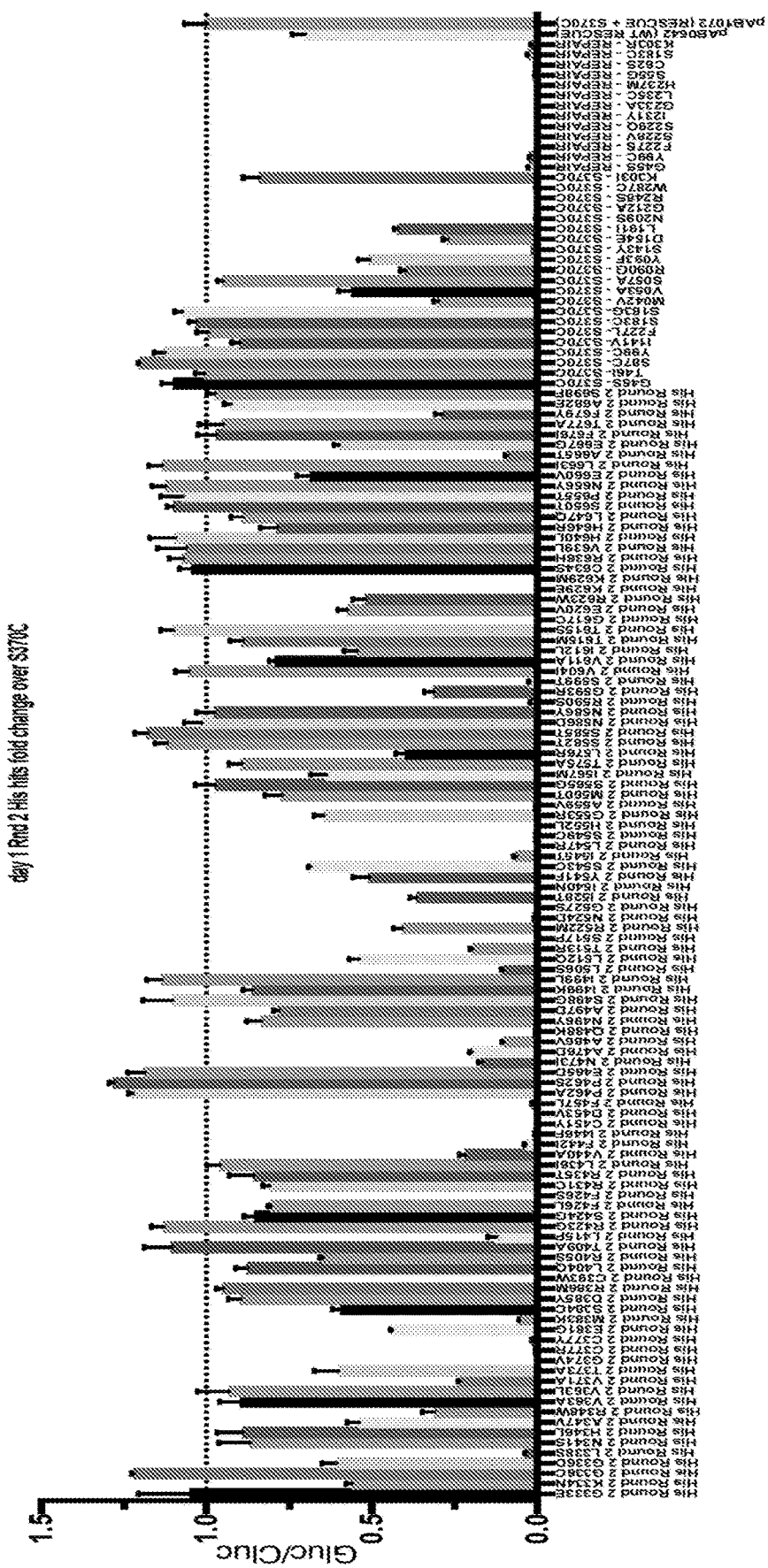
FIG. 69 shows activities of ADAR mutations screened.
Figure 70:
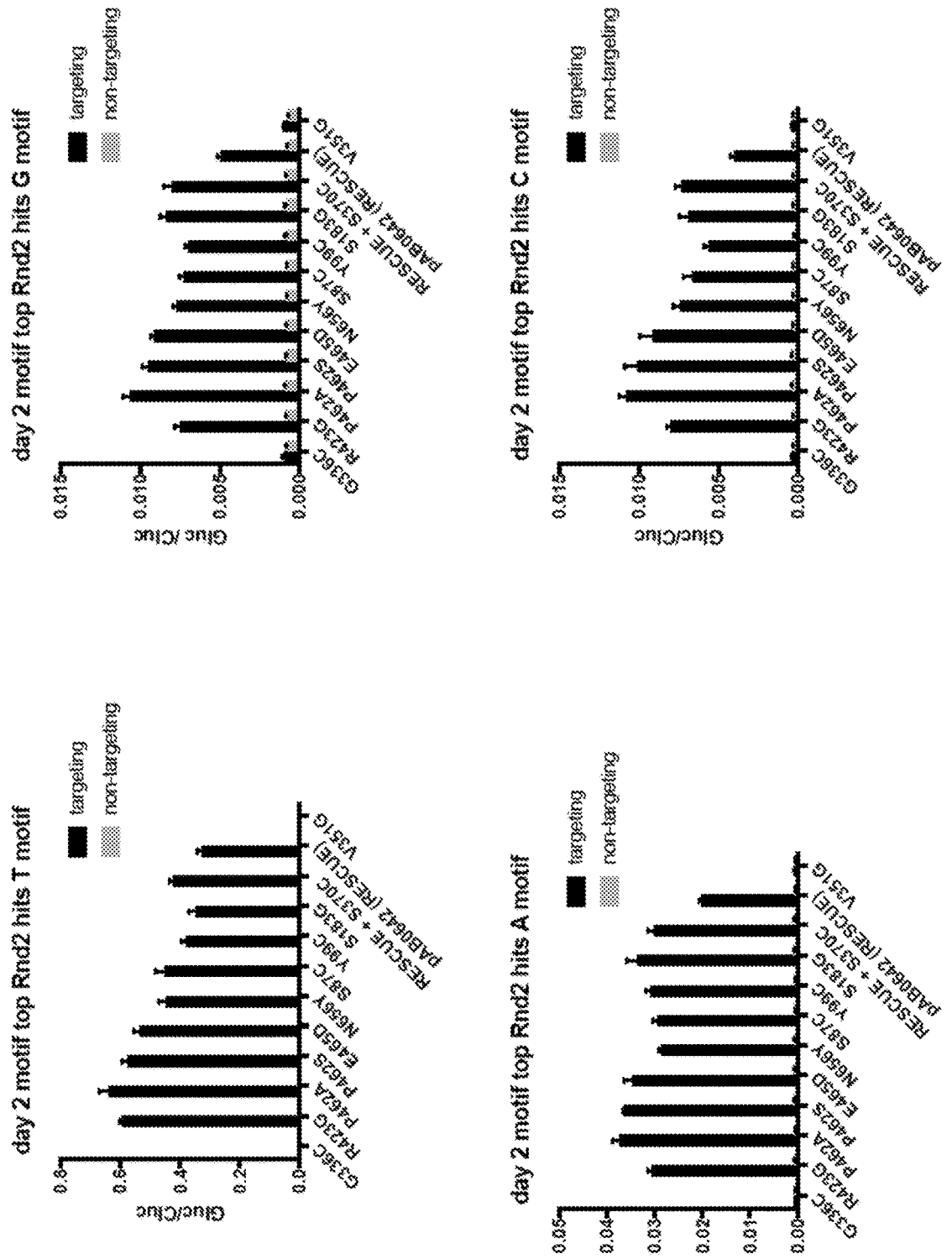
FIG. 70 shows activities of mutation P462A on different motifs.
Figure 71:
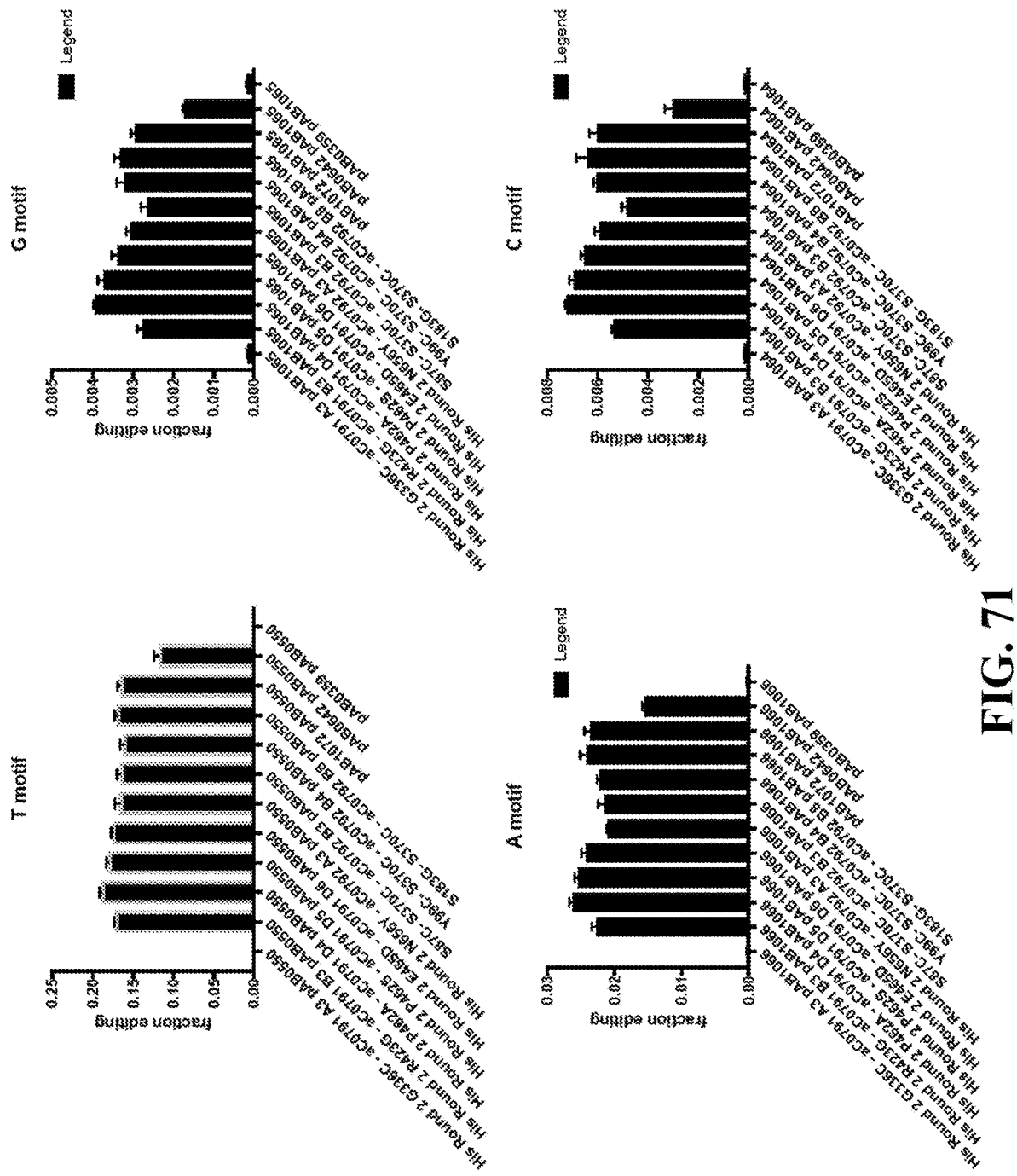
FIG. 71 shows mutation P462 improved the motifs.

Additional ADAR mutations were also screened. Activities of these mutations were tested (FIG. 69). In the screenings, mutation P462A performed better on all tested motifs (FIG. 70). Mutation P462 improved the motifs (FIG. 71)

Figure 72:
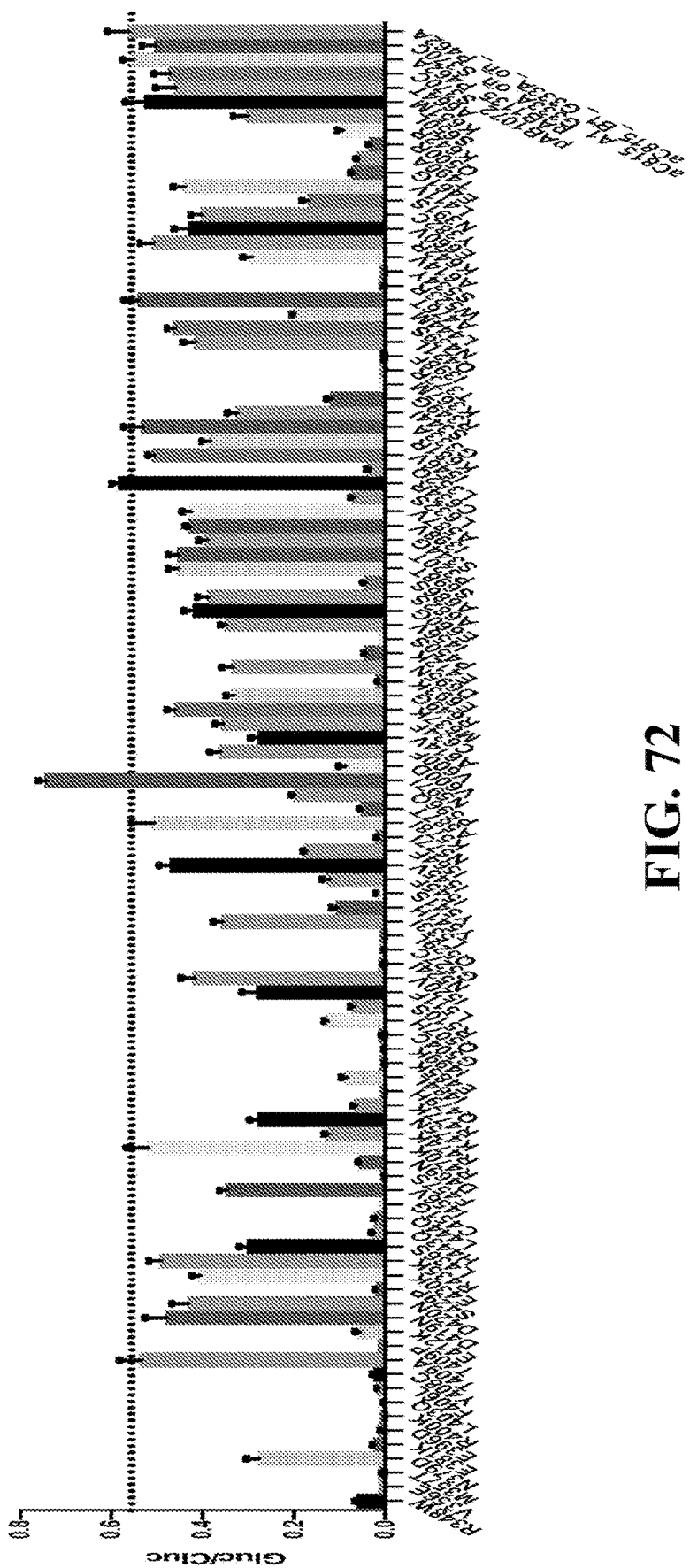
FIG. 72 shows activities of ADAR mutation screening that identified N579I.
Figure 73:
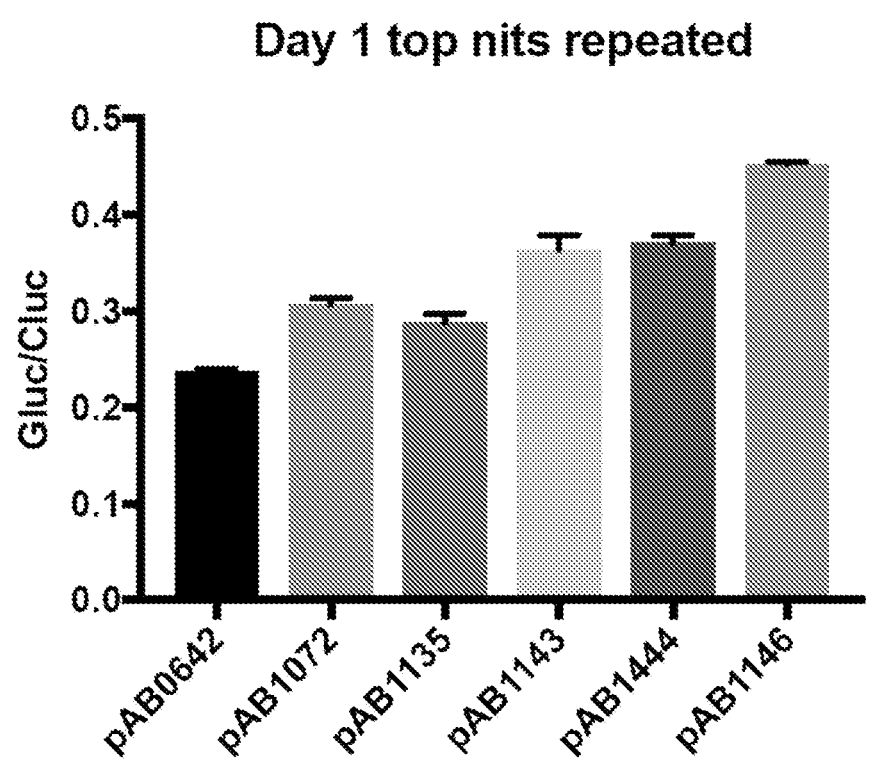
FIG. 73 shows validation of N579I.

Applicant further identified another mutation, N579I, with certain enhances activities (FIG. 72). N579I was validated by adding this mutations to RESCUEv3 (i.e., pAB0642), RESCUEv4 (i.e., pAB1072), RESCUEv5 (i.e., pAB1135), and RESCUEv6 (i.e., pAB1146). Plasmids pAB1143 and pAB1144 were G333A on RESCUEv4 and RESCUEv5, respectively (FIG. 73).

Figure 74:
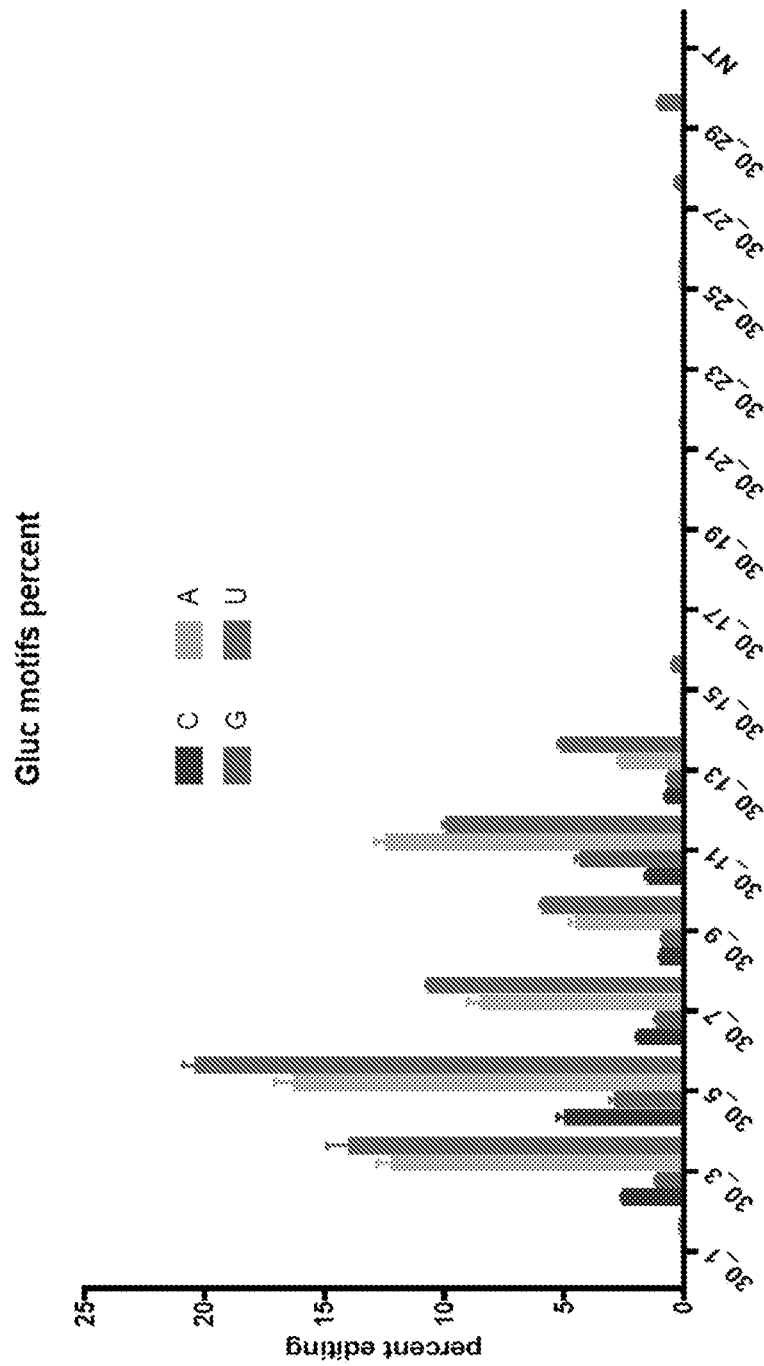
FIG. 74 shows performance of RESCUEv3 with 30 bp guides.

Applicant also tested the performance of RESCUEv3 with 30 bp guides (FIG. 74). The 30 bp guides were named as follows: the first number is the length of the guide (i.e., 30 bp) and the second number is the position of the mismatch from the 5' end of the guide.

Figure 75:
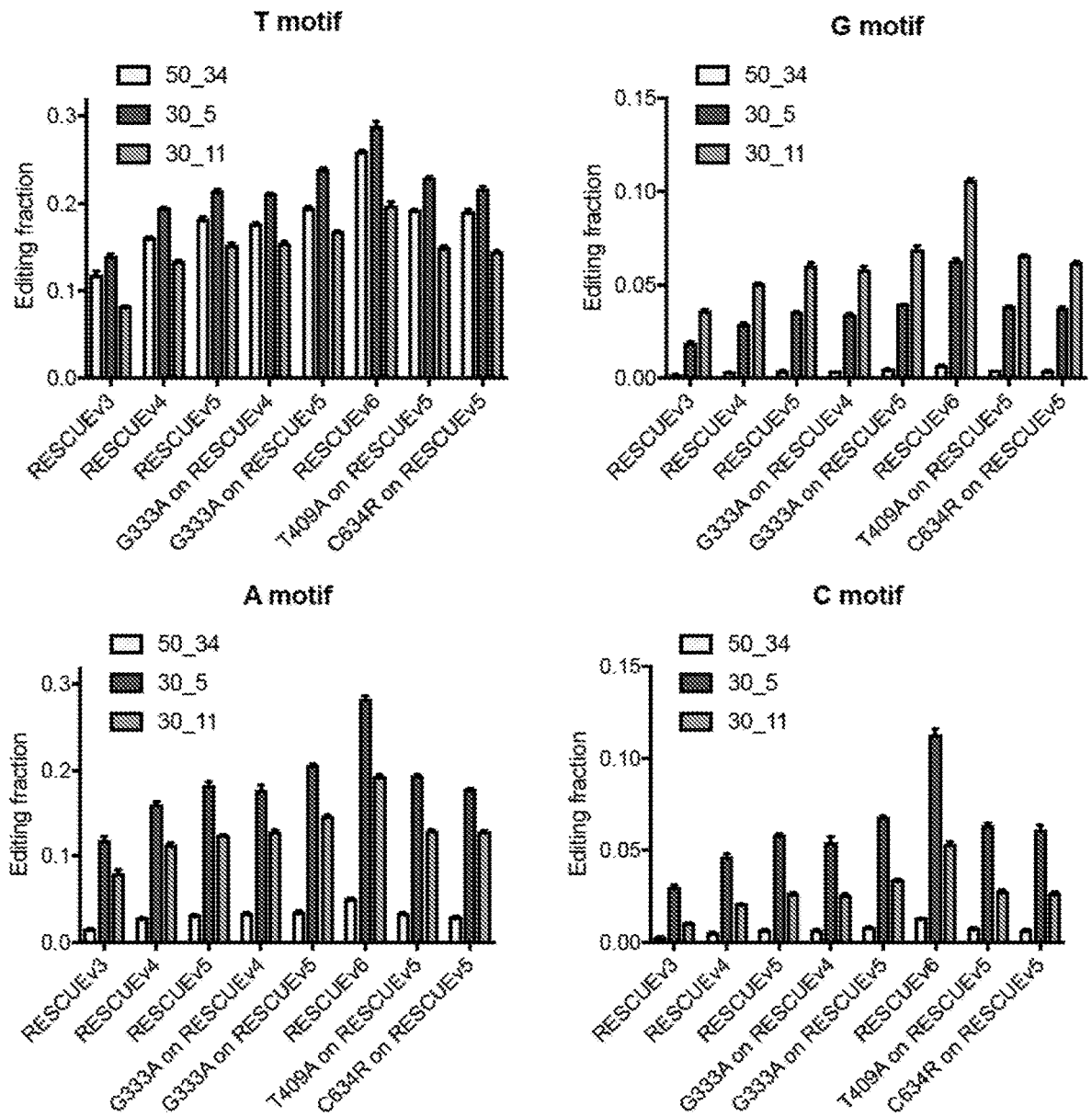
FIG. 75 shows comparison of 50 bp guides and 30 bp guides with various ADAR mutants.

Applicant then compared 50 bp guides with two 30 bp guides (30_5 and 30_11). Activities of RESCUE mutants with these guides on various motifs are shown in FIG. 75. The result shows that RESCUEv6 outperformed all other constructs on all 5' motifs (TC, GC, AC, and CC), allowing for greater than 10% editing on each potential motif. Note that the optimal guide design for GC was slightly different than the design TC, AC, and CC. Thus provided herein are processes for optimizing guide design for each embodiment.

Figure 76:
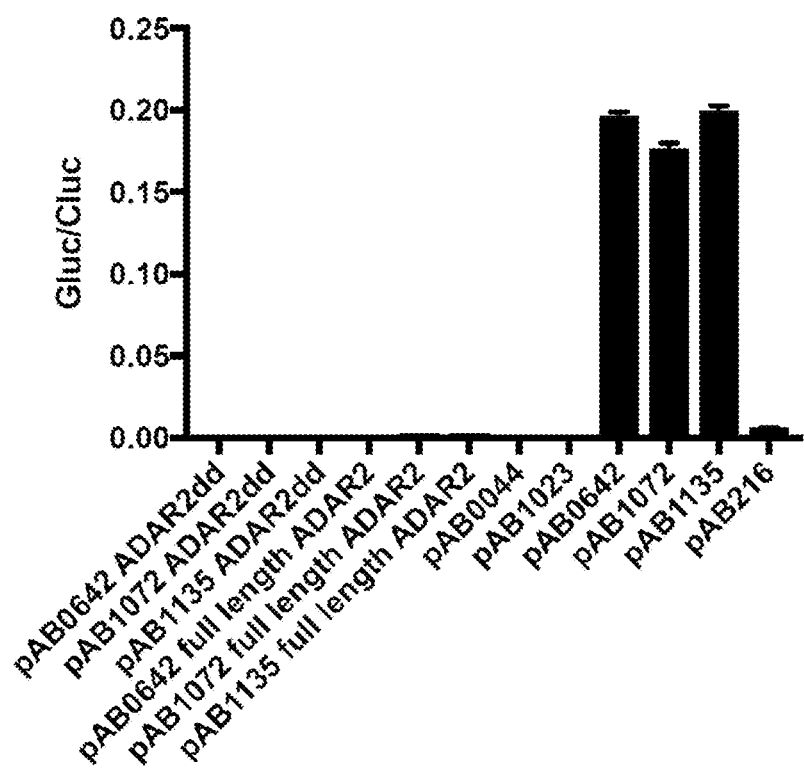
FIG. 76 shows that the activities of ADAR mutations were Cas13 dependent.

In certain embodiments, location of the RESCUE mutations on the deaminase domain alone or full-length ADAR delivered with targeting Cas13 guide did not allow for editing. The deaminase domain showed activities when fused to Cas13 for programmable activity (FIG. 76).

Various modifications and variations of the described methods, pharmaceutical compositions, and kits of the invention will be apparent to those skilled in the art without departing from the scope and spirit of the invention. Although the invention has been described in connection with specific embodiments, it will be understood that it is capable of further modifications and that the invention as claimed should not be unduly limited to such specific embodiments. Indeed, various modifications of the described modes for carrying out the invention that are obvious to those skilled in the art are intended to be within the scope of the invention. This application is intended to cover any variations, uses, or adaptations of the invention following, in general, the principles of the invention and including such departures from the present disclosure come within known customary practice within the art to which the invention pertains and may be applied to the essential features herein before set forth.

SEQUENCE LISTING (805 sequences)

SEQ ID NO: 1 - protein, 15 aa, Artificial
  Synthetic Peptide
GGGGSGGGGSGGGGS

SEQ ID NO: 2 - protein, 20 aa, Artificial
  Synthetic Peptide
GGGGSGGGGSGGGGSGGGGS

SEQ ID NO: 3 - protein, 25 aa, Artificial
  Synthetic Peptide
GGGGSGGGGSGGGGSGGGGSGGGGS

SEQ ID NO: 4 - protein, 30 aa, Artificial
  Synthetic Peptide
GGGGSGGGGSGGGGSGGGGSGGGGSGGGGS

SEQ ID NO: 5 - protein, 35 aa, Artificial
  Synthetic Peptide
GGGGSGGGGSGGGGSGGGGSGGGGSGGGGSGGGGS

SEQ ID NO: 6 - protein, 40 aa, Artificial
  Synthetic Peptide
GGGGSGGGGSGGGGSGGGGSGGGGSGGGGSGGGGSGGGGS

SEQ ID NO: 7 - protein, 45 aa, Artificial
  Synthetic Peptide
GGGGSGGGGSGGGGSGGGGSGGGGSGGGGSGGGGSGGGGSGGGGS

SEQ ID NO: 8 - protein, 50 aa, Artificial
  Synthetic Peptide
GGGGSGGGGSGGGGSGGGGSGGGGSGGGGSGGGGSGGGGSGGGGSGGGGS

SEQ ID NO: 9 - protein, 55 aa, Artificial
  Synthetic Peptide
GGGGSGGGGSGGGGSGGGGSGGGGSGGGGSGGGGSGGGGSGGGGSGGGGSGGGGS

SEQ ID NO: 10 - protein, 15 aa, Artificial
  Synthetic Peptide
GSGGSGGSGGSGGSG

SEQ ID NO: 11 - protein, 32 aa, Artificial
  Synthetic Peptide
LEPGEKPYKCPECGKSFSQSGALTRHQRTHTR

SEQ ID NO: 12 - protein, 9 aa, Artificial
  Synthetic Peptide
GGSGGSGGS

SEQ ID NO: 13 - protein, 15 aa, Artificial
  Synthetic Peptide
GGGGSGGGGSGGGGS

SEQ ID NO: 14 - protein, 5 aa, Artificial
  Synthetic Peptide
GGGGS

SEQ ID NO: 15 - protein, 10 aa, Artificial
  Synthetic Peptide
GGGGSGGGGS

SEQ ID NO: 16 - protein, 20 aa, Artificial
  Synthetic Peptide
PKKKRKVEASSPKKRKVEAS

SEQ ID NO: 17 - protein, 7 aa, Simian virus 40
PKKKRKV

SEQ ID NO: 18 - protein, 9 aa, Simian virus 40
PKKKRKVEA

SEQ ID NO: 19 - protein, 16 aa, Artificial
  Synthetic Peptide
KRPAATKKAGQAKKKK

SEQ ID NO: 20 - protein, 9 aa, Homo sapiens
PAAKRVKLD

SEQ ID NO: 21 - protein, 11 aa, Homo sapiens
RQRRNELKRSP

SEQ ID NO: 22 - protein, 38 aa, Homo sapiens
NQSSNFGPMKGGNFGGRSSGPYGGGGQYFAKPRNQGGY

SEQ ID NO: 23 - protein, 42 aa, Homo sapiens
RMRIZFKNKGKDTAELRRRRVEVSVELRKAKKDEQILKRRNV

SEQ ID NO: 24 - protein, 8 aa, Homo sapiens
VSRKRPRP

SEQ ID NO: 25 - protein, 8 aa, Homo sapiens
PPKKARED

SEQ ID NO: 26 - protein, 8 aa, Homo sapiens
PQPKKKPL

SEQ ID NO: 27 - protein, 12 aa, Mus sp.
SALIKKKKKMAP

SEQ ID NO: 28 - protein, 5 aa, Influenza virus
DRLRR

SEQ ID NO: 29 - protein, 7 aa, Influenza virus
PKQKKRK

SEQ ID NO: 30 - protein, 10 aa, Hepatitis D virus
RKLKKKIKKL

SEQ ID NO: 31 - protein, 10 aa, Mus sp.
REKKKFLKRR

SEQ ID NO: 32 - protein, 20 aa, Homo sapiens
KRKGDEVDGVDEVAKKKSKK

SEQ ID NO: 33 - protein, 17 aa, Homo sapiens
RKCLQAGMNLEARKTKK

SEQ ID NO: 34 - protein, 1340 aa, Lachnospiraceae bacterium MA2020
MQISKVNHKHVAVGQKDRERITGFIYNDPVGDEKSLEDVVAKRANDTKVLFNVFNTKDLYDSQESDKSEKDKEIISKGAKFVAKSFNSAITILKKQNKIYSTLTSQQVIKELKDKFGGARIYDDDIEEALTETLKKSFRKENVRNSIKVLIENAAGIRSSLSKDEEELIQEYFVKQLVEEYTKTKLQKNVVKSIKNQNMVIQPDSDSQVLSLSESRREKQSSAVSSDTLVNCKEKDVLKAFLTDYAVLDEDERNSLLWKLRNLVNLYFYGSESIRDYSYTKEKSVWKEHDEQKANKTLFIDEICHITKIGKNGKEQKVLDYEENRSRCRKQNINYYRSALNYAKNNTSGIFENEDSNHFWIHLIENEVERLYNGIENGEEFKFETGYISEKVWKAVINHLSIKYIALGKAVYNYAMKELSSPGDIEPGKIDDSYINGITSFDYEIIKAEESLQRDISMNVVFATNYLACATVDTDKDFLLFSKEDIRSCTKKDGNLCKNIMQFWGGYSTWKNFCEEYLKDDKDALELLYSLKSMLYSMRNSSFHFSTENVDNGSWDTELIGKLFEEDCNRAARIEKEKFYNNNLHMFYSSSLLEKVLERLYSSHHERASQVPSFNRVFVRKNFPSSLSEQRITPKFTDSKDEQIWQSAVYYLCKEIYYNDFLQSKEAYKLFREGVKNLDKNDINNQKAADSFKQAVVYYGKAIGNATLSQVCQAIMTEYNRQNNDGLKKKSAYAEKQNSNKYKHYPLFLKQVLQSAFWEYLDENKEIYGFISAQIHKSNVEIKAEDFIANYSSQQYKKLVDKVKKTPELQKWYTLGRLINPRQANQFLGSIRNYVQFVKDIQRRAKENGNPIRNYYEVLESDSIIKILEMCTKLNGTTSNDIHDYFRDEDEYAEYISQFVNFGDVHSGAALNAFCNSESEGKKNGIYYDGINPIVNRNWVLCKLYGSPDLISKIISRVNENMIHDFHKQEDLIREYQIKGICSNKKEQQDLRTFQVLKNRVELRDIVEYSEIINELYGQLIKWCYLRERDLMYFQLGFHYLCLNNASSKEADYIKINVDDRNISGAILYQIAAMYINGLPVYYKKDDMYVALKSGKKASDELNSNEQTSKKINYFLKYGNNILGDKKDQLYLAGLELFENVAEHENIIIFRNEIDHFHYFYDRDRSMLDLYSEVFDRFFTYDMKLRKNVVNMLYNILLDHNIVSSFVFETGEKKVGRGDSEVIKPSAKIRLRANNGVSSDVFTYKVGSKDELKIATLPAKNEEFLLNVARLIYYPDMEAVSENMVREGVVKVEKSNDKKGKISRGSNTRSSNQSKYNNKSKNRMNYSMGSIFEKMDLKFD

SEQ ID NO: 35 - protein, 1437 aa, Lachnospiraceae bacterium NK4A179
MKISKVREENRGAKLTVNAKTAVVSENRSQEGILYNDPSRYGKSRKNDEDRDRYIESRLKSSGKLYRIFNEDKNKRETDELQWFLSEIVKKINRRNGLVLSDMLSVDDRAFEKAFEKYAELSYTNRRNKVSGSPAFETCGVDAATAERLKGIISETNFINRIKNNIDNKVSEDIIDRIIAKYLKKSLCRERVKRGLKKLLMNAFDLPYSDPDIDVQRDFIDYVLEDFYHVRAKSQVSRSIKNMNMPVQPEGDGKFAITVSKGGTESGNKRSAEKEAFKKFLSDYASLDERVRDDMLRRMRRLVVLYFYGSDDSKLSDVNEKFDVWEDHAARRVDNREFIKLPLENKLANGKTDKDAERIRKNTVKELYRNQNIGCYRQAVKAVEEDNNGRYFDDKMLNMFFIHRIEYGVEKIYANLKQVTEFKARTGYLSEKIWKDLINYISIKYIAMGKAVYNYAMDELNASDKKEIELGKISEEYLSGISSFDYELIKAEEMLQRETAVYVAFAARHLSSQTVELDSENSDFLLLKPKGTMDKNDKNKLASNNILNFLKDKETLRDTILQYFGGHSLWTDFPFDKYLAGGKDDVDFLTDLKDVIYSMRNDSFHYATENHNNGKWNKELISAMFEHETERMTVVMKDKFYSNNLPMFYKNDDLKKLLIDLYKDNVERASQVPSFNKVFVRKNFPALVRDKDNLGIELDLKADADKGENELKFYNALYYMFKEIYYNAFLNDKNVRERFITKATKVADNYDRNKERNLKDRIKSAGSDEKKKLREQLQNYIAENDFGQRIKNIVQVNPDYTLAQICQLIMTEYNQQNNGCMQKKSAARKDINKDSYQHYKMLLLVNLRKAFLEFIKENYAFVLKPYKHDLCDKADFVPDFAKYVKPYAGLISRVAGSSELQKWYIVSRFLSPAQANHMLGFLHSYKQYVWDIYRRASETGTEINHSIAEDKIAGVDITDVDAVIDLSVKLCGTISSEISDYFKDDEVYAEYISSYLDFEYDGGNYKDSLNRFCNSDAVNDQKVALYYDGEHPKLNRNIILSKLYGERRFLEKITDRVSRSDIVEYYKLKKETSQYQTKGIFDSEDEQKNIKKFQEMKNIVEFRDLMDYSEIADELQGQLINWIYLRERDLMNFQLGYHYACLNNDSNKQATYVTLDYQGKKNRKINGAILYQICAMYINGLPLYYVDKDSSEWTVSDGKESTGAKIGEFYRYAKSFENTSDCYASGLEIFENISEHDNITELRNYIEHFRYYSSFDRSFLGIYSEVFDRFFTYDLKYRKNVPTILYNILLQHFVNVRFEFVSGKKMIGIDKKDRKIAKEKECARITIREKNGVYSEQFTYKLKNGTVYVDARDKRYLQSIIRLLFYPEKVNMDEMIEVKEKKKPSDNNTGKGYSKRDRQQDRKEYDKYKEKKKKEGNFLSGMGGNINWDEINAQLKN

SEQ ID NO: 36 - protein, 1385 aa, Clostridium aminophilum
MKFSKVDHTRSAVGIQKATDSVHGMLYTDPKKQEVNDLDKRFDQLNVKAKRLYNVFNQSKAEEDDDEKRFGKVVKKLNRELKDLLFHREVSRYNSIGNAKYNYYGIKSNPEEIVSNLGMVESLKGERDPQKVISKLLLYYLRKGLKPGTDGLRMILEASCGLRKLSGDEKELKVFLQTLDEDFEKKTFKKNLIRSIENQNMAVQPSNEGDPIIGITQGRFNSQKNEEKSAIERMMSMYADLNEDHREDVLRKLRRLNVLYFNVDTEKTEEPTLPGEVDTNPVFEVWHDHEKGKENDRQFATFAKILTEDRETRKKEKLAVKEALNDLKSAIRDHNIMAYRCSIKVTEQDKDGLFFEDQRINRFWIHHIESAVERILASINPEKLYKLRIGYLGEKVWKDLLNYLSIKYIAVGKAVFHFAMEDLGKTGQDIELGKLSNSVSGGLTSFDYEQIRADETLQRQLSVEVAFAANNLFRAVVGQTGKKIEQSKSEENEEDFLLWKAEKIAESIKKEGEGNTLKSILQFFGGASSWDLNHFCAAYGNESSALGYETKFADDLRKAIYSLRNETFHFTTLNKGSFDWNAKLIGDMFSHEAATGIAVERTRFYSNNLPMFYRESDLKRIMDHLYNTYHPRASQVPSFNSVFVRKNFRLFLSNTLNTNTSFDTEVYQKWESGVYYLFKEIYYNSFLPSGDAHHLFFEGLRRIRKEADNLPIVGKEAKKRNAVQDFGRRCDELKNLSLSAICQMIMTEYNEQNNGNRKVKSTREDKRKPDIFQHYKMLLLRTLQEAFAIYIRREEFKFIFDLPKTLYVMKPVEEFLPNWKSGMFDSLVERVKQSPDLQRWYVLCKFLNGRLLNQLSGVIRSYIQFAGDIQRRAKANHNRLYMDNTQRVEYYSNVLEVVDFCIKGTSRFSNVFSDYFRDEDAYADYLDNYLQFKDEKIAEVSSFAALKTFCNEEEVKAGIYMDGENPVMQRNIVMAKLFGPDEVLKNVVPKVTREEIEEYYQLEKQIAPYRQNGYCKSEEDQKKLLRFQRIKNRVEFQTITEFSEIINELLGQLISWSFLRERDLLYFQLGFHYLCLHNDTEKPAEYKEISREDGTVIRNAILHQVAAMYVGGLPVYTLADKKLAAFEKGEADCKLSISKDTAGAGKKIKDFFRYSKYVLIKDRMLTDQNQKYTIYLAGLELFENTDEHDNITDVRKYVDHFKYYATSDENAMSILDLYSEIHDRFFTYDMKYQKNVANMLENILLRHFVLIRPEFFTGSKKVGEGKKITCKARAQIEIAENGMRSEDFTYKLSDGKKNISTCMIAARDQKYLNTVARLLYYPHEAKKSIVDTREKKNNKKTNRGDGTFNKQKGTARKEKDNGPREFNDTGFSNTPFAGFDPFRNS

SEQ ID NO: 37 - protein, 1175 aa, Carnobacterium gallinarum
MRITKVKIKLDNKLYQVTMQKEEKYGTLKLNEESRKSTAEILRLKKASFNKSFHSKTINSQKENKNATIKKNGDYISQIFEKLVGVDTNKNIRKPKMSLTDLKDLPKKDLALFIKRKFKNDDIVEIKNLDLISLFYNALQKVPGEHFTDESWADFCQEMMPYREYKNKFIERKIILLANSIEQNKGFSINPETFSKRKRVLHQWAIEVQERGDFSILDEKLSKLAEIYNFKKMCKRVQDELNDLEKSMKKGKNPEKEKEAYKKQKNFKIKTIWKDYPYKTHIGLIEKIKENEELNQFNIEIGKYFEHYFPIKKERCTEDEPYYLNSETIATTVNYQLKNALISYLMQIGKYKQFGLENQVLDSKKLQEIGIYEGFQTKFMDACVFATSSLKNIIEPMRSGDILGKREFKEAIATSSFVNYHHFFPYFPFELKGMKDRESELIPFGEQTEAKQMQNIWALRGSVQQIRNEIFHSFDKNQKFNLPQLDKSNFEFDASENSTGKSQSYIETDYKFLFEAEKNQLEQFFIERIKSSGALEYYPLKSLEKLFAKKEMKFSLGSQVVAFAPSYKKLVKKGHSYQTATEGTANYLGLSYYNRYELKEESFQAQYYLLKLIYQYVFLPNFSQGNSPAFRETVKAILRINKDEARKKMKKNKKFLRKYAFEQVREMEFKETPDQYMSYLQSEMREEKVRKAEKNDKGFEKNITMNFEKLLMQIFVKGFDVFLTTFAGKELLLSSEEKVIKETEISLSKKINEREKTLKASIQVEHQLVATNSAISYWLFCKLLDSRHLNELRNEMIKFKQSRIKFNHTQHAELIQNLLPIVELTILSNDYDEKNDSQNVDVSAYFEDKSLYETAPYVQTDDRTRVSFRPILKLEKYHTKSLIEALLKDNPQFRVAATDIQEWMHKREEIGELVEKRKNLHTEWAEGQQTLGAEKREEYRDYCKKIDRFNWKANKVTLTYLSQLHYLITDLLGRMVGFSALFERDLVYFSRSFSELGGETYHISDYKNLSGVLRLNAEVKPIKIKNIKVIDNEENPYKGNEPEVKPFLDRLHAYLENVIGIKAVHGKIRNQTAHLSVLQLELSMIESMNNLRDLMAYDRKLKNAVTKSMIKILDKHGMILKLKIDENHKNFEIESLIPKEIIHLKDKAIKTNQVSEEYCQLVLALLTTNPGNQLN

SEQ ID NO: 38 - protein, 1164 aa, Carnobacterium gallinarum
MRMTKVKINGSPVSMNRSKLNGHLVWNGTTNTVNILTKKEQSFAASFLNKTLVKADQVKGYKVLAENIFIIFEQLEKSNSEKPSVYLNNIRRLKEAGLKRFFKSKYHEEIKYTSEKNQSVPTKLNLIPLFFNAVDRIQEDKFDEKNWSYFCKEMSPYLDYKKSYLNRKKEILANSIQQNRGFSMPTAEEPNLLSKRKQLFQQWAMKFQESPLIQQNNFAVEQFNKEFANKINELAAVYNVDELCTAITEKLMNFDKDKSNKTRNFEIKKLWKQHPHNKDKALIKLFNQEGNEALNQFNIELGKYFEHYFPKTGKKESAESYYLNPQTIIKTVGYQLRNAFVQYLLQVGKLHQYNKGVLDSQTLQEIGMYEGFQTKFMDACVFASSSLRNIIQATTNEDILTREKFKKELEKNVELKHDLFFKTEIVEERDENPAKKIAMTPNELDLWAIRGAVQRVRNQIFHQQINKRHEPNQLKVGSFENGDLGNVSYQKTIYQKLFDAEIKDIEIYFAEKIKSSGALEQYSMKDLEKLFSNKELTLSLGGQVVAFAPSYKKLYKQGYFYQNEKTIELEQFTDYDFSNDVFKANYYLIKLIYHYVFLPQFSQANNKLFKDTVHYVIQQNKELNTTEKDKKNNKKIRKYAFEQVKLMKNESPEKYMQYLQREMQEERTIKEAKKTNEEKPNYNFEKLLIQIFIKGFDTFLRNFDLNLNPAEELVGTVKEKAEGLRKRKERIAKILNVDEQIKTGDEEIAFWIFAKLLDARHLSELRNEMIKFKQSSVKKGLIKNGDLIEQMQPILELCILSNDSESMEKESFDKIEVFLEKVELAKNEPYMQEDKLTPVKFRFMKQLEKYQTRNFIENLVIENPEFKVSEKIVLNWHEEKEKIADLVDKRTKLHEEWASKAREIEEYNEKIKKNKSKKLDKPAEFAKFAEYKIICEAIENFNRLDHKVRLTYLKNLHYLMIDLMGRMVGFSVLFERDFVYMGRSYSALKKQSIYLNDYDTFANIRDWEVNENKHLFGTSSSDLTFQETAEFKNLKKPMENQLKALLGVTNHSFEIRNNIAHLHVLRNDGKGEGVSLLSCMNDLRKLMSYDRKLKNAVTKAIIKILDKHGMILKLTNNDHTKPFEIESLKPKKIIHLEKSNHSFPMDQVSQEYCDLVKKMLVFTN

SEQ ID NO: 39 - protein, 1154 aa, Paludibacter propionicigenes
MRVSKVKVKDGGKDKMVLVHRKTTGAQLVYSGQPVSNETSNILPEKKRQSFDLSTLNKTIIKFDTAKKQKLNVDQYKIVEKIFKYPKQELPKQIKAEEILPFLNHKFQEPVKYWKNGKEESFNLTLLIVEAVQAQDKRKLQPYYDWKTWYIQTKSDLLKKSIENNRIDLTENLSKRKKALLAWETEFTASGSIDLTHYHKVYMTDVLCKMLQDVKPLTDDKGKINTNAYHRGLKKALQNHQPAIFGTREVPNEANRADNQLSIYHLEVVKYLEHYFPIKTSKRRNTADDIAHYLKAQTLKTTIEKQLVNAIRANIIQQGKTNHHELKADTTSNDLIRIKTNEAFVLNLTGTCAFAANNIRNMVDNEQTNDILGKGDFIKSLLKDNTNSQLYSFFFGEGLSTNKAEKETQLWGIRGAVQQIRNNVNHYKKDALKTVFNISNFENPTITDPKQQTNYADTIYKARFINELEKIPEAFAQQLKTGGAVSYYTIENLKSLLTTFQFSLCRSTIPFAPGFKKVFNGGINYQNAKQDESFYELMLEQYLRKENFAEESYNARYFMLKLIYNNLFLPGFTTDRKAFADSVGFVQMQNKKQAEKVNPRKKEAYAFEAVRPMTAADSIADYMAYVQSELMQEQNKKEEKVAEETRINFEKFVLQVFIKGFDSFLRAKEFDFVQMPQPQLTATASNQQKADKLNQLEASITADCKLTPQYAKADDATHIAFYVFCKLLDAAHLSNLRNELIKFRESVNEFKFHHLLEIIEICLLSADVVPTDYRDLYSSEADCLARLRPFIEQGADITNWSDLFVQSDKHSPVIHANIELSVKYGTTKLLEQIINKDTQFKTTEANFTAWNTAQKSIEQLIKQREDHHEQWVKAKNADDKEKQERKREKSNFAQKFIEKHGDDYLDICDYINTYNWLDNKMHFVHLNRLHGLTIELLGRMAGFVALFDRDFQFFDEQQIADEFKLHGFVNLHSIDKKLNEVPTKKIKEIYDIRNKIIQINGNKINESVRANLIQFISSKRNYYNNAFLHVSNDEIKEKQMYDIRNHIAHFNYLTKDAADFSLIDLINELRELLHYDRKLKNAVSKAFIDLFDKHGMILKLKLNADHKLKVESLEPKKIYHLGSSAKDKPEYQYCTNQVMMAYCNMCRSLLEMKK

SEQ ID NO: 40 - protein, 970 aa, Listeria weihenstephanensis
MLALLHQEVPSQKLHNLKSLNTESLTKLFKPKFQNMISYPPSKGAEHVQFCLTDIAVPAIRDLDEIKPDWGIFFEKLKPYTDWAESYIHYKQTTIQKSIEQNKIQSPDSPRKLVLQKYVTAFLNGEPLGLDLVAKKYKLADLAESFKVVDLNEDKSANYKIKACLQQHQRNILDELKEDPELNQYGIEVKKYIQRYFPIKRAPNRSKHARADFLKKELIESTVEQQFKNAVYHYVLEQGKMEAYELTDPKTKDLQDIRSGEAFSFKFINACAFASNNLKMILNPECEKDILGKGDFKKNLPNSTTQSDVVKKMIPFFSDEIQNVNFDEAIWAIRGSIQQIRNEVYHCKKHSWKSILKIKGFEFEPNNMKYTDSDMQKLMDKDIAKIPDFIEEKLKSSGIIRFYSHDKLQSIWEMKQGFSLLTTNAPFVPSFKRVYAKGHDYQTSKNRYYDLGLTTFDILEYGEEDFRARYFLTKLVYYQQFMPWFTADNNAFRDAANFVLRLNKNRQQDAKAFINIREVEEGEMPRDYMGYVQGQIAIHEDSTEDTPNHFEKFISQVFIKGFDSHMRSADLKFIKNPRNQGLEQSEIEEMSFDIKVEPSFLKNKDDYIAFWTFCKMLDARHLSELRNEMIKYDGHLTGEQEIIGLALLGVDSRENDWKQFFSSEREYEKIMKGYVGEELYQREPYRQSDGKTPILFRGVEQARKYGTETVIQRLFDASPEFKVSKCNITEWERQKETIEETIERRKELHNEWEKNPKKPQNNAFFKEYKECCDAIDAYNWHKNKTTLVYVNELHHLLIEILGRYVGYVAIADRDFQCMANQYFKHSGITERVEYWGDNRLKSIKKLDTFLKKEGLFVSEKNARNHIAHLNYLSLKSECTLLYLSERLREIFKYDRKLKNAVSKSLIDILDRHGMSVVFANLKENKHRLVIKSLEPKKLRHLGEKKIDNGYIETNQVSEEYCGIVKRLLEI

SEQ ID NO: 41 - protein, 1051 aa, Listeria newyorkensis
MKITKMRVDGRTIVMERTSKEGQLGYEGIDGNKTTEIIFDKKKESFYKSILNKTVRKPDEKEKNRRKQAINKAINKEITELMLAVLHQEVPSQKLHNLKSLNTESLTKLFKPKFQNMISYPPSKGAEHVQFCLTDIAVPAIRDLDEIKPDWGIFFEKLKPYTDWAESYIHYKQTTIQKSIEQNKIQSPDSPRKLVLQKYVTAFLNGEPLGLDLVAKKYKLADLAESFKLVDLNEDKSANYKIKACLQQHQRNILDELKEDPELNQYGIEVKKYIQRYFPIKRAPNRSKHARADFLKKELIESTVEQQFKNAVYHYVLEQGKMEAYELTDPKTKDLQDIRSGEAFSFKFINACAFASNNLKMILNPECEKDILGKGNFKKNLPNSTTRSDVVKKMIPFFSDELQNVNFDEAIWAIRGSIQQIRNEVYHCKKHSWKSILKIKGFEFEPNNMKYADSDMQKLMDKDIAKIPEFIEEKLKSSGVVRFYRHDELQSIWEMKQGFSLLTTNAPFVPSFKRVYAKGHDYQTSKNRYYNLDLTTFDILEYGEEDFRARYFLTKLVYYQQFMPWFTADNNAFRDAANFVLRLNKNRQQDAKAFINIREVEEGEMPRDYMGYVQGQIAIHEDSIEDTPNHFEKFISQVFIKGFDRHMRSANLKFIKNPRNQGLEQSEIEEMSFDIKVEPSFLKNKDDYIAFWIFCKMLDARHLSELRNEMIKYDGHLTGEQEIIGLALLGVDSRENDWKQFFSSEREYEKIMKGYVVEELYQREPYRQSDGKTPILFRGVEQARKYGTETVIQRLFDANPEFKVSKCNLAEWERQKETIEETIKRRKELHNEWAKNPKKPQNNAFFKEYKECCDAIDAYNWHKNKTTLAYVNELHHLLIEILGRYVGYVAIADRDFQCMANQYFKHSGITERVEYWGDNRLKSIKKLDTFLKKEGLFVSEKNARNHIAHLNYLSLKSECTLLYLSERLREIFKYDRKLKNAVSKSLIDILDRHGMSVVFANLKENKHRLVIKSLEPKKLRHLGGKKIDGGYIETNQVSEEYCGIVKRLLEM

SEQ ID NO: 42 - protein, 1152 aa, Leptotrichia wadei
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENDITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALE

SEQ ID NO: 43 - protein, 1285 aa, Rhodobacter capsulatus
MQIGKVQGRTISEFGDPAGGLKRKISTDGKNRKELPAHLSSDPKALIGQWISGIDKIYRKPDSRKSDGKAIHSPTPSKMQFDARDDLGEAFWKLVSEAGLAQDSDYDQFKRRLHPYGDKFQPADSGAKLKFEADPPEPQAFHGRWYGAMSKRGNDAKELAAALYEHLHVDEKRIDGQPKRNPKTDKFAPGLVVARALGIESSVLPRGMARLARNWGEEEIQTYFVVDVAASVKEVAKAAVSAAQAFDPPRQVSGRSLSPKVGFALAEHLERVTGSKRCSFDPAAGPSVLALHDEVKKTYKRLCARGKNAARAFPADKTELLALMRHTHENRVRNQMVRMGRVSEYRGQQAGDLAQSHYWTSAGQTEIKESEIFVRLWVGAFALAGRSMKAWIDPMGKIVNTEKNDRDLTAAVNIRQVISNKEMVAEAMARRGIYFGETPELDRLGAEGNEGFVFALLRYLRGCRNQTFHLGARAGFLKEIRKELEKTRWGKAKEAEHVVLTDKTVAAIRAIIDNDAKALGARLLADLSGAFVAHYASKEHFSTLYSEIVKAVKDAPEVSSGLPRLKLLLKRADGVRGYVHGLRDTRKHAFATKLPPPPAPRELDDPATKARYIALLRLYDGPFRAYASGITGTALAGPAARAKEAATALAQSVNVTKAYSDVMEGRTSRLRPPNDGETLREYLSALTGETATEFRVQIGYESDSENARKQAEFIENYRRDMLAFMFEDYIRAKGFDWILKIEPGATAMTRAPVLPEPIDTRGQYEHWQAALYLVMHFVPASDVSNLLHQLRKWEALQGKYELVQDGDATDQADARREALDLVKRFRDVLVLFLKTGEARFEGRAAPFDLKPFRALFANPATFDRLFMATPTTARPAEDDPEGDGASEPELRVARTLRGLRQIARYNHMAVLSDLFAKHKVRDEEVARLAEIEDETQEKSQIVAAQELRTDLHDKVMKCHPKTISPEERQSYAAAIKTIEEHRFLVGRVYLGDHLRLHRLMMDVIGRLIDYAGAYERDTGTFLINASKQLGAGADWAVTIAGAANTDARTQTRKDLAHFNVLDRADGTPDLTALVNRAREMMAYDRKRKNAVPRSILDMLARLGLTLKWQMKDHLLQDATITQAAIKHLDKVRLTVGGPAAVTEARFSQDYLQMVAAVFNGSVQNPKPRRRDDGDAWHKPPKPATAQSQPDQKPPNKAPSAGSRLPPPQVGEVYEGVVVKVIDTGSLGFLAVEGVAGNIGLHISRLRRIREDAIIVGRRYRFRVEIYVPPKSNTSKLNAADLVRID

SEQ ID NO: 44 - protein, 1285 aa, Rhodobacter capsulatus
MQIGKVQGRTISEFGDPAGGLKRKISTDGKNRKELPAHLSSDPKALIGQWISGIDKIYRKPDSRKSDGKAIHSPTPSKMQFDARDDLGEAFWKLVSEAGLAQDSDYDQFKRRLHPYGDKFQPADSGAKLKFEADPPEPQAFHGRWYGAMSKRGNDAKELAAALYEHLHVDEKRIDGQPKRNPKTDKFAPGLVVARALGIESSVLPRGMARLARNWGEEEIQTYFVVDVAASVKEVAKAAVSAAQAFDPPRQVSGRSLSPKVGFALAEHLERVTGSKRCSFDPAAGPSVLALHDEVKKTYKRLCARGKNAARAFPADKTELLALMRHTHENRVRNQMVRMGRVSEYRGQQAGDLAQSHYWTSAGQTEIKESEIFVRLWVGAFALAGRSMKAWIDPMGKIVNTEKNDRDLTAAVNIRQVISNKEMVAEAMARRGIYFGETPELDRLGAEGNEGFVFALLRYLRGCRNQTFHLGARAGFLKEIRKELEKTRWGKAKEAEHVVLTDKTVAAIRAIIDNDAKALGARLLADLSGAFVAHYASKEHFSTLYSEIVKAVKDAPEVSSGLPRLKLLLKRADGVRGYVHGLRDTRKHAFATKLPPPPAPRELDDPATKARYIALLRLYDGPFRAYASGITGTALAGPAARAKEAATALAQSVNVTKAYSDVMEGRSSRLRPPNDGETLREYLSALTGETATEFRVQIGYESDSENARKQAEFIENYRRDMLAFMFEDYIRAKGFDWILKIEPGATAMTRAPVLPEPIDTRGQYEHWQAALYLVMHFVPASDVSNLLHQLRKWEALQGKYELVQDGDATDQADARREALDLVKRFRDVLVLFLKTGEARFEGRAAPFDLKPFRALFANPATFDRLFMATPTTARPAEDDPEGDGASEPELRVARTLRGLRQIARYNHMAVLSDLFAKHKVRDEEVARLAEIEDETQEKSQIVAAQELRTDLHDKVMKCHPKTISPEERQSYAAAIKTIEEHRFLVGRVYLGDHLRLHRLMMDVIGRLIDYAGAYERDTGTFLINASKQLGAGADWAVTIAGAANTDARTQTRKDLAHFNVLDRADGTPDLTALVNRAREMMAYDRKRKNAVPRSILDMLARLGLTLKWQMKDHLLQDATITQAAIKHLDKVRLTVGGPAAVTEARFSQDYLQMVAAVFNGSVQNPKPRRRDDGDAWHKPPKPATAQSQPDQKPPNKAPSAGSRLPPPQVGEVYEGVVVKVIDTGSLGFLAVEGVAGNIGLHISRLRRIREDAIIVGRRYRFRVEIYVPPKSNTSKLNAADLVRID

SEQ ID NO: 45 - protein, 1285 aa, Rhodobacter capsulatus; identical to SEQ ID NO: 44

SEQ ID NO: 46 - protein, 1389 aa, Leptotrichia shahii
MGNLFGHKRWYEVRDKKDFKIKRKVKVKRNYDGNKYILNINENNNKEKIDNNKFIRKYINYKKNDNILKEFTRKFHAGNILFKLKGKEGIIRIENNDDFLETEEVVLYIEAYGKSEKLKALGITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDDKIDVILTNFMEIREKIKSNLEILGFVKFYLNVGGDKKKSKNKKMLVEKILNINVDLTVEDIADFVIKELEFWNITKRIEKVKKVNNEFLEKRRNRTYIKSYVLLDKHEKFKIERENKKDKIVKFFVENIKNNSIKEKIEKILAEFKIDELIKKLEKELKKGNCDTEIFGIFKKHYKVNFDSKKFSKKSDEEKELYKIIYRYLKGRIEKILVNEQKVRLKKMEKIEIEKILNESILSEKILKRVKQYTLEHIMYLGKLRHNDIDMTTVNTDDFSRLHAKEELDLELITFFASTNMELNKIFSRENINNDENIDFFGGDREKNYVLDKKILNSKIKIIRDLDFIDNKNNITNNFIRKFTKIGTNERNRILHAISKERDLQGTQDDYNKVINIIQNLKISDEEVSKALNLDVVFKDKKNIITKINDIKISEENNNDIKYLPSFSKVLPEILNLYRNNPKNEPFDTIETEKIVLNALIYVNKELYKKLILEDDLEENESKNIFLQELKKTLGNIDEIDENIIENYYKNAQISASKGNNKAIKKYQKKVIECYIGYLRKNYEELFDFSDFKMNIQEIKKQIKDINDNKTYERITVKTSDKTIVINDDFEYIISIFALLNSNAVINKIRNRFFATSVWLNTSEYQNIIDILDEIMQLNTLRNECITENWNLNLEEFIQKMKEIEKDFDDFKIQTKKEIFNNYYEDIKNNILTEFKDDINGCDVLEKKLEKIVIFDDETKFEIDKKSNILQDEQRKLSNINKKDLKKKVDQYIKDKDQEIKSKILCRIIFNSDFLKKYKKEIDNLIEDMESENENKFQEIYYPKERKNELYIYKKNLFLNIGNPNFDKIYGLISNDIKMADAKFLFNIDGKNIRKNKISEIDAILKNLNDKLNGYSKEYKEKYIKKLKENDDFFAKNIQNKNYKSFEKDYNRVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFKLIGNNDILERLMKPKKVSVLELESYNSDYIKNLIIELLTKIENTNDTL

SEQ ID NO: 47 - protein, 1197 aa, Leptotrichia wadei
MKVTKVDGISHKKYIEEGKLVKSTSEENRTSERLSELLSIRLDIYIKNPDNASEEENRIRRENLKKFFSNKVLHLKDSVLYLKNRKEKNAVQDKNYSEEDISEYDLKNKNSFSVLKKILLNEDVNSEELEIFRKDVEAKLNKINSLKYSFEENKANYQKINENNVEKVGGKSKRNIIYDYYRESAKRNDYINNVQEAFDKLYKKEDIEKLFFLIENSKKHEKYKIREYYHKIIGRKNDKENFAKIIYEEIQNVNNIKELIEKIPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQVGEIATSDFIARNRQNEAFLRNIIGVSSVAYFSLRNILETENENDITGRMRGKTVKNNKGEEKYVSGEVDKIYNENKQNEVKENLKMFYSYDFNMDNKNEIEDFFANIDEAISSIRHGIVHFNLELEGKDIFAFKNIAPSEISKKMFQNEINEKKLKLKIFKQLNSANVFNYYEKDVIIKYLKNTKFNFVNKNIPFVPSFTKLYNKIEDLRNTLKFFWSVPKDKEEKDAQIYLLKNIYYGEFLNKFVKNSKVFFKITNEVIKINKQRNQKTGHYKYQKFENIEKTVPVEYLAIIQSREMINNQDKEEKNTYIDFIQQIFLKGFIDYLNKNNLKYIESNNNNDNNDIFSKIKIKKDNKEKYDKILKNYEKHNRNKEIPHEINEFVREIKLGKILKYTENLNMFYLILKLLNHKELTNLKGSLEKYQSANKEETFSDELELINLLNLDNNRVTEDFELEANEIGKFLDFNENKIKDRKELKKFDTNKIYFDGENIIKHRAFYNIKKYGMLNLLEKIADKAKYKISLKELKEYSNKKNEIEKNYTMQQNLHRKYARPKKDEKFNDEDYKEYEKAIGNIQKYTHLKNKVEFNELNLLQGLLLKILHRLVGYTSIWERDLRFRLKGEFPENHYIEEIFNFDNSKNVKYKSGQIVEKYINFYKELYKDNVEKRSIYSDKKVKKLKQEKKDLYIRNYIAHFNYIPHAEISLLEVLENLRKLLSYDRKLKNAIMKSIVDILKEYGFVATFKIGADKKIEIQTLESEKIVHLKNLKKKKLMTDRNSEELCELVKVMFEYKALEKRPAATKKAGQAKKKKGSYPYDVPDYAYPYDVPDYAYPYDVPDYA

SEQ ID NO: 48 - protein, 1120 aa, Listeria seeligeri
MWISIKTLIHHLGVLFFCDYMYNRREKKIIEVKTMRITKVEVDRKKVLISRDKNGGKLVYENEMQDNTEQIMHHKKSSFYKSVVNKTICRPEQKQMKKLVHGLLQENSQEKIKVSDVTKLNISNFLNHRFKKSLYYFPENSPDKSEEYRIEINLSQLLEDSLKKQQGTFICWESFSKDMELYINWAENYISSKTKLIKKSIRNNRIQSTESRSGQLMDRYMKDILNKNKPFDIQSVSEKYQLEKLTSALKATFKEAKKNDKEINYKLKSTLQNHERQIIEELKENSELNQFNIEIRKHLETYFPIKKTNRKVGDIRNLEIGEIQKIVNHRLKNKIVQRILQEGKLASYEIESTVNSNSLQKIKIEEAFALKFINACLFASNNLRNMVYPVCKKDILMIGEFKNSFKEIKHKKFIRQWSQFFSQEITVDDIELASWGLRGAIAPIRNEIIHLKKHSWKKFFNNPTFKVKKSKIINGKTKDVTSEFLYKETLFKDYFYSELDSVPELIINKMESSKILDYYSSDQLNQVFTIPNFELSLLTSAVPFAPSFKRVYLKGFDYQNQDEAQPDYNLKLNIYNEKAFNSEAFQAQYSLFKMVYYQVFLPQFTTNNDLFKSSVDFILTLNKERKGYAKAFQDIRKMNKDEKPSEYMSYIQSQLMLYQKKQEEKEKINHFEKFINQVFIKGFNSFIEKNRLTYICHPTKNTVPENDNIEIPFHTDMDDSNIAFWLMCKLLDAKQLSELRNEMIKFSCSLQSTEEISTFTKAREVIGLALLNGEKGCNDWKELFDDKEAWKKNMSLYVSEELLQSLPYTQEDGQTPVINRSIDLVKKYGTETILEKLFSSSDDYKVSAKDIAKLHEYDVTEKIAQQESLHKQWIEKPGLARDSAWTKKYQNVINDISNYQWAKTKVELTQVRHLHQLTIDLLSRLAGYMSIADRDFQFSSNYILERENSEYRVTSWILLSENKNKNKYNDYELYNLKNASIKVSSKNDPQLKVDLKQLRLTLEYLELFDNRLKEKRNNISHFNYLNGQLGNSILELFDDARDVLSYDRKLKNAVSKSLKEILSSHGMEVTFKPLYQTNHHLKIDKLQPKKIHHLGEKSTVSSNQVSNEYCQLVRTLLTMK

SEQ ID NO: 49 - protein, 1159 aa, Leptotrichia buccalis
MKVTKVGGISHKKYTSEGRLVKSESEENRTDERLSALLNMRLDMYIKNPSSTETKENQKRIGKLKKFFSNKMVYLKDNTLSLKNGKKENIDREYSETDILESDVRDKKNFAVLKKIYLNENVNSEELEVFRNDIKKKLNKINSLKYSFEKNKANYQKINENNIEKVEGKSKRNIIYDYYRESAKRDAYVSNVKEAFDKLYKEEDIAKLVLEIENLTKLEKYKIREFYHEIIGRKNDKENFAKIIYEEIQNVNNMKELIEKVPDMSELKKSQVFYKYYLDKEELNDKNIKYAFCHFVEIEMSQLLKNYVYKRLSNISNDKIKRIFEYQNLKKLIENKLLNKLDTYVRNCGKYNYYLQDGEIATSDFIARNRQNEAFLRNIIGVSSVAYFSLRNILETENENDITGRMRGKTVKNNKGEEKYVSGEVDKIYNENKKNEVKENLKMFYSYDFNMDNKNEIEDFFANIDEAISSIRHGIVHFNLELEGKDIFAFKNIAPSEISKKMFQNEINEKKLKLKIFRQLNSANVFRYLEKYKILNYLKRTRFEFVNKNIPFVPSFTKLYSRIDDLKNSLGIYWKTPKTNDDNKTKEIIDAQIYLLKNIYYGEFLNYFMSNNGNFFEISKEIIELNKNDKRNLKTGFYKLQKFEDIQEKIPKEYLANIQSLYMINAGNQDEEEKDTYIDFIQKIFLKGFMTYLANNGRLSLIYIGSDEETNTSLAEKKQEFDKFLKKYEQNNNIKIPYEINEFLREIKLGNILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKIADKAGYKISIEELKKYSNKKNEIEKNHKMQENLHRKYARPRKDEKFTDEDYESYKQAIENIEEYTHLKNKVEFNELNLLQGLLLRILHRLVGYTSIWERDLRFRLKGEFPENQYIEEIFNFENKKNVKYKGGQIVEKYIKFYKELHQNDEVKINKYSSANIKVLKQEKKDLYIRNYIAHFNYIPHAEISLLEVLENLRKLLSYDRKLKNAVMKSVVDILKEYGFVATFKIGADKKIGIQTLESEKIVHLKNLKKKKLMTDRNSEELCKLVKIMFEYKMEEKKSEN

SEQ ID NO: 50 - protein, 1285 aa, Herbinix hemicellulosilytica
MKLTRRRISGNSVDQKITAAFYRDMSQGLLYYDSEDNDCTDKVIESMDFERSWRGRILKNGEDDKNPFYMFVKGLVGSNDKIVCEPIDVDSDPDNLDILINKNLTGFGRNLKAPDSNDTLENLIRKIQAGIPEEEVLPELKKIKEMIQKDIVNRKEQLLKSIKNNRIPFSLEGSKLVPSTKKMKWLFKLIDVPNKTFNEKMLEKYWEIYDYDKLKANITNRLDKTDKKARSISRAVSEELREYHKNLRTNYNRFVSGDRPAAGLDNGGSAKYNPDKEEFLLFLKEVEQYFKKYFPVKSKHSNKSKDKSLVDKYKNYCSYKVVKKEVNRSIINQLVAGLIQQGKLLYYFYYNDTWQEDFLNSYGLSYIQVEEAFKKSVMTSLSWGINRLTSFFIDDSNTVKFDDITTKKAKEAIESNYFNKLRTCSRMQDHFKEKLAFFYPVYVKDKKDRPDDDIENLIVLVKNAIESVSYLRNRTFHFKESSLLELLKELDDKNSGQNKIDYSVAAEFIKRDIENLYDVFREQIRSLGIAEYYKADMISDCFKTCGLEFALYSPKNSLMPAFKNVYKRGANLNKAYIRDKGPKETGDQGQNSYKALEEYRELTWYIEVKNNDQSYNAYKNLLQLIYYHAFLPEVRENEALITDFINRTKEWNRKETEERLNTKNNKKHKNFDENDDITVNTYRYESIPDYQGESLDDYLKVLQRKQMARAKEVNEKEEGNNNYIQFIRDVVVWAFGAYLENKLKNYKNELQPPLSKENIGLNDTLKELFPEEKVKSPFNIKCRFSISTFIDNKGKSTDNTSAEAVKTDGKEDEKDKKNIKRKDLLCFYLFLRLLDENEICKLQHQFIKYRCSLKERRFPGNRTKLEKETELLAELEELMELVRFTMPSIPEISAKAESGYDTMIKKYFKDFIEKKVFKNPKTSNLYYHSDSKTPVTRKYMALLMRSAPLHLYKDIFKGYYLITKKECLEYIKLSNIIKDYQNSLNELHEQLERIKLKSEKQNGKDSLYLDKKDFYKVKEYVENLEQVARYKHLQHKINFESLYRIFRIHVDIAARMVGYTQDWERDMHFLFKALVYNGVLEERRFEAIFNNNDDNNDGRIVKKIQNNLNNKNRELVSMLCWNKKLNKNEFGAIIWKRNPIAHLNHFTQTEQNSKSSLESLINSLRILLAYDRKRQNAVTKTINDLLLNDYHIRIKWEGRVDEGQIYFNIKEKEDIENEPIIHLKHLHKKDCYIYKNSYMFDKQKEWICNGIKEEVYDKSILKCIGNLFKFDYEDKNKSSANPKHT

SEQ ID NO: 51 - protein, 1344 aa, Eubacterium rectale
MLRRDKEVKKLYNVFNQIQVGTKPKKWNNDEKLSPEENERRAQQKNIKMKNYKWREACSKYVESSQRIINDVIFYSYRKAKNKLRYMRKNEDILKKMQEAEKLSKFSGGKLEDFVAYTLRKSLVVSKYDTQEFDSLAAMVVFLECIGKNNISDHEREIVCKLLELIRKDFSKLDPNVKGSQGANIVRSVRNQNMIVQPQGDRFLFPQVYAKENETVTNKNVEKEGLNEFLLNYANLDDEKRAESLRKLRRILDVYFSAPNHYEKDMDITLSDNIEKEKFNVWEKHECGKKETGLFVDIPDVLMEAEAENIKLDAVVEKRERKVLNDRVRKQNIICYRYTRAVVEKYNSNEPLFFENNAINQYWIHHIENAVERILKNCKAGKLFKLRKGYLAEKVWKDAINLISIKYIALGKAVYNFALDDIWKDKKNKELGIVDERIRNGITSFDYEMIKAHENLQRELAVDIAFSVNNLARAVCDMSNLGNKESDFLLWKRNDIADKLKNKDDMASVSAVLQFFGGKSSWDINIFKDAYKGKKKYNYEVRFIDDLRKAIYCARNENFHFKTALVNDEKWNTELFGKIFERETEFCLNVEKDRFYSNNLYMFYQVSELRNMLDHLYSRSVSRAAQVPSYNSVIVRTAFPEYITNVLGYQKPSYDADTLGKWYSACYYLLKEIYYNSFLQSDRALQLFEKSVKTLSWDDKKQQRAVDNFKDHFSDIKSACTSLAQVCQIYMTEYNQQNNQIKKVRSSNDSIFDQPVYQHYKVLLKKAIANAFADYLKNNKDLFGFIGKPFKANEIREIDKEQFLPDWTSRKYEALCIEVSGSQELQKWYIVGKFLNARSLNLMVGSMRSYIQYVTDIKRRAASIGNELHVSVHDVEKVEKWVQVIEVCSLLASRTSNQFEDYFNDKDDYARYLKSYVDFSNVDMPSEYSALVDFSNEEQSDLYVDPKNPKVNRNIVHSKLFAADHILRDIVEPVSKDNIEEFYSQKAEIAYCKIKGKEITAEEQKAVLKYQKLKNRVELRDIVEYGEIINELLGQLINWSFMRERDLLYFQLGFHYDCLRNDSKKPEGYKNIKVDENSIKDAILYQIIGMYVNGVTVYAPEKDGDKLKEQCVKGGVGVKVSAFHRYSKYLGLNEKTLYNAGLEIFEVVAEHEDIINLRNGIDHFKYYLGDYRSMLSIYSEVFDRFFTYDIKYQKNVLNLLQNILLRHNVIVEPILESGFKTIGEQTKPGAKLSIRSIKSDTFQYKVKGGTLITDAKDERYLETIRKILYYAENEEDNLKKSVVVTNADKYEKNKESDDQNKQKEKKNKDNKGKKNEETKSDAEKNNNERLSYNPFANLNFKLSN

SEQ ID NO: 52 - protein, 1373 aa, Eubacteriaceae bacterium CHKCI004
MKISKESHKRTAVAVMEDRVGGVVYVPGGSGIDLSNNLKKRSMDTKSLYNVFNQIQAGTAPSEYEWKDYLSEAENKKREAQKMIQKANYELRRECEDYAKKANLAVSRIIFSKKPKKIFSDDDIISHMKKQRLSKFKGRMEDFVLIALRKSLVVSTYNQEVFDSRKAATVFLKNIGKKNISADDERQIKQLMALIREDYDKWNPDKDSSDKKESSGTKVIRSIEHQNMVIQPEKNKLSLSKISNVGKKTKTKQKEKAGLDAFLKEYAQIDENSRMEYLKKLRRLLDTYFAAPSSYIKGAAVSLPENINFSSELNVWERHEAAKKVNINFVEIPESLLNAEQNNNKINKVEQEHSLEQLRTDIRRRNITCYHFANALAADERYHTLFFENMAMNQFWIHHMENAVERILKKCNVGTLFKLRIGYLSEKVWKDMLNLLSIKYIALGKAVYHFALDDIWKADIWKDASDKNSGKINDLTLKGISSFDYEMVKAQEDLQREMAVGVAFSTNNLARVTCKMDDLSDAESDFLLWNKEAIRRHVKYTEKGEILSAILQFFGGRSLWDESLFEKAYSDSNYELKFLDDLKRAIYAARNETFHFKTAAIDGGSWNTRLFGSLFEKEAGLCLNVEKNKFYSNNLVLFYKQEDLRVFLDKLYGKECSRAAQIPSYNTILPRKSFSDFMKQLLGLKEPVYGSAILDQWYSACYYLFKEVYYNLFLQDSSAKALFEKAVKALKGADKKQEKAVESFRKRYWEISKNASLAEICQSYITEYNQQNNKERKVRSANDGMFNEPIYQHYKMLLKEALKMAFASYIKNDKELKFVYKPTEKLFEVSQDNFLPNWNSEKYNTLISEVKNSPDLQKWYIVGKFMNARMLNLLLGSMRSYLQYVSDIQKRAAGLGENQLHLSAENVGQVKKWIQVLEVCLLLSVRISDKFTDYFKDEEEYASYLKEYVDFEDSAMPSDYSALLAFSNEGKIDLYVDASNPKVNRNIIQAKLYAPDMVLKKVVKKISQDECKEFNEKKEQIMQFKNKGDEVSWEEQQKILEYQKLKNRVELRDLSEYGELINELLGQLINWSYLRERDLLYFQLGFHYSCLMNESKKPDAYKTIRRGTVSIENAVLYQIIAMYINGFPVYAPEKGELKPQCKTGSAGQKIRAFCQWASMVEKKKYELYNAGLELFEVVKEHDNIIDLRNKIDHFKYYQGNDSILALYGEIFDRFFTYDMKYRNNVLNHLQNILLRHNVIIKPIISKDKKEVGRGKMKDRAAFLLEEVSSDRFTYKVKEGERKIDAKNRLYLETVRDILYFPNRAVNDKGEDVIICSKKAQDLNEKKADRDKNHDKSKDTNQKKEGKNQEEKSENKEPYSDRMTWKPFAGIKLE

SEQ ID NO: 53 - protein, 1276 aa, Blautia species
MKISKVDHVKSGIDQKLSSQRGMLYKQPQKKYEGKQLEEHVRNLSRKAKALYQVFPVSGNSKMEKELQIINSFIKNILLRLDSGKTSEEIVGYINTYSVASQISGDHIQELVDQHLKESLRKYTCVGDKRIYVPDIIVALLKSKFNSETLQYDNSELKILIDFIREDYLKEKQIKQIVHSIENNSTPLRIAEINGQKRLIPANVDNPKKSYIFEFLKEYAQSDPKGQESLLQHMRYLILLYLYGPDKITDDYCEEIEAWNFGSIVMDNEQLFSEEASMLIQDRIYVNQQIEEGRQSKDTAKVKKNKSKYRMLGDKIEHSINESVVKHYQEACKAVEEKDIPWIKYISDHVMSVYSSKNRVDLDKLSLPYLAKNTWNTWISFIAMKYVDMGKGVYHFAMSDVDKVGKQDNLIIGQIDPKFSDGISSFDYERIKAEDDLHRSMSGYIAFAVNNFARAICSDEFRKKNRKEDVLTVGLDEIPLYDNVKRKLLQYFGGASNWDDSIIDIIDDKDLVACIKENLYVARNVNFHFAGSEKVQKKQDDILEEIVRKETRDIGKHYRKVFYSNNVAVFYCDEDIIKLMNHLYQREKPYQAQIPSYNKVISKTYLPDLIFMLLKGKNRTKISDPSIMNMFRGTFYFLLKEIYYNDFLQASNLKEMFCEGLKNNVKNKKSEKPYQNFMRRFEELENMGMDFGEICQQIMTDYEQQNKQKKKTATAVMSEKDKKIRTLDNDTQKYKHFRTLLYIGLREAFIIYLKDEKNKEWYEFLREPVKREQPEEKEFVNKWKLNQYSDCSELILKDSLAAAWYVVAHFINQAQLNHLIGDIKNYIQFISDIDRRAKSTGNPVSESTEIQIERYRKILRVLEFAKFFCGQITNVLTDYYQDENDFSTHVGHYVKFEKKNMEPAHALQAFSNSLYACGKEKKKAGFYYDGMNPIVNRNITLASMYGNKKLLENAMNPVTEQDIRKYYSLMAELDSVLKNGAVCKSEDEQKNLRHFQNLKNRIELVDVLTLSELVNDLVAQLIGWVYIRERDMMYLQLGLHYIKLYFTDSVAEDSYLRTLDLEEGSIADGAVLYQIASLYSFNLPMYVKPNKSSVYCKKHVNSVATKFDIFEKEYCNGDETVIENGLRLFENINLHKDMVKFRDYLAHFKYFAKLDESILELYSKAYDFFFSYNIKLKKSVSYVLTNVLLSYFINAKLSFSTYKSSGNKTVQHRTTKISVVAQTDYFTYKLRSIVKNKNGVESIENDDRRCEVVNIAARDKEFVDEVCNVINYNSDK

SEQ ID NO: 54 - protein, 1385 aa, Leptotrichia species
MGNLFGHKRWYEVRDKKDFKIKRKVKVKRNYDGNKYILNINENNNKEKIDNNKFIGEFVNYKKNNNVLKEFKRKFHAGNILFKLKGKEEIIRIENNDDFLETEEVVLYIEVYGKSEKLKALEITKKKIIDEAIRQGITKDDKKIEIKRQENEEEIEIDIRDEYTNKTLNDCSIILRIIENDELETKKSIYEIFKNINMSLYKIIEKIIENETEKVFENRYYEEHLREKLLKDNKIDVILTNFMEIREKIKSNLEIMGFVKFYLNVSGDKKKSENKKMFVEKILNTNVDLTVEDIVDFIVKELKFWNITKRIEKVKKFNNEFLENRRNRTYIKSYVLLDKHEKFKIERENKKDKIVKFFVENIKNNSIKEKIEKILAEFKINELIKKLEKELKKGNCDTEIFGIFKKHYKVNFDSKKFSNKSDEEKELYKIIYRYLKGRIEKILVNEQKVRLKKMEKIEIEKILNESILSEKILKRVKQYTLEHIMYLGKLRHNDIVKMTVNTDDFSRLHAKEELDLELITFFASTNMELNKIFNGKEKVTDFFGFNLNGQKITLKEKVPSFKLNILKKLNFINNENNIDEKLSHFYSFQKEGYLLRNKILHNSYGNIQETKNLKGEYENVEKLIKELKVSDEEISKSLSLDVIFEGKVDIINKINSLKIGEYKDKKYLPSFSKIVLEITRKFREINKDKLFDIESEKIILNAVKYVNKILYEKITSNEENEFLKTLPDKLVKKSNNKKENKNLLSIEEYYKNAQVSSSKGDKKAIKKYQNKVTNAYLEYLENTFTEIIDFSKFNLNYDEIKTKIEERKDNKSKIIIDSISTNINITNDIEYIISIFALLNSNTYINKIRNRFFATSVWLEKQNGTKEYDYENIISILDEVLLINLLRENNITDILDLKNAIIDAKIVENDETYIKNYIFESNEEKLKKRLFCEELVDKEDIRKIFEDENFKFKSFIKKNEIGNFKINFGILSNLECNSEVEAKKIIGKNSKKLESFIQNIIDEYKSNIRTLFSSEFLEKYKEEIDNLVEDTESENKNKFEKIYYPKEHKNELYIYKKNLFLNIGNPNFDKIYGLISKDIKNVDTKILFDDDIKKNKISEIDAILKNLNDKLNGYSNDYKAKYVNKLKENDDFFAKNIQNENYSSFGEFEKDYNKVSEYKKIRDLVEFNYLNKIESYLIDINWKLAIQMARFERDMHYIVNGLRELGIIKLSGYNTGISRAYPKRNGSDGFYTTTAYYKFFDEESYKKFEKICYGFGIDLSENSEINKPENESIRNYISHFYIVRNPFADYSIAEQIDRVSNLLSYSTRYNNSTYASVFEVFKKDVNLDYDELKKKFRLIGNNDILERLMKPKKVSVLELESYNSDYIKNLIIELLTKIENTNDTL

SEQ ID NO: 55 - protein, 1334 aa, Lachnospiraceae bacterium NK4A144
MKISKVDHTRMAVAKGNQHRRDEISGILYKDPTKTGSIDFDERFKKLNCSAKILYHVFNGIAEGSNKYKNIVDKVNNNLDRVLFTGKSYDRKSIIDIDTVLRNVEKINAFDRISTEEREQIIDDLLEIQLRKGLRKGKAGLREVLLIGAGVIVRTDKKQEIADFLEILDEDFNKTNQAKNIKLSIENQGLVVSPVSRGEERIFDVSGAQKGKSSKKAQEKEALSAFLLDYADLDKNVRFEYLRKIRRLINLYFYVKNDDVMSLTEIPAEVNLEKDFDIWRDHEQRKEENGDFVGCPDILLADRDVKKSNSKQVKIAERQLRESIREKNIKRYRFSIKTIEKDDGTYFFANKQISVFWIHRIENAVERILGSINDKKLYRLRLGYLGEKVWKDILNFLSIKYIAVGKAVFNFAMDDLQEKDRDIEPGKISENAVNGLTSFDYEQIKADEMLQREVAVNVAFAANNLARVTVDIPQNGEKEDILLWNKSDIKKYKKNSKKGILKSILQFFGGASTWNMKMFEIAYHDQPGDYEENYLYDIIQIIYSLRNKSFHFKTYDHGDKNWNRELIGKMIEHDAERVISVEREKFHSNNLPMFYKDADLKKILDLLYSDYAGRASQVPAFNTVLVRKNFPEFLRKDMGYKVHFNNPEVENQWHSAVYYLYKEIYYNLFLRDKEVKNLFYTSLKNIRSEVSDKKQKLASDDFASRCEEIEDRSLPEICQIIMTEYNAQNFGNRKVKSQRVIEKNKDIFRHYKMLLIKTLAGAFSLYLKQERFAFIGKATPIPYETTDVKNFLPEWKSGMYASFVEEIKNNLDLQEWYIVGRFLNGRMLNQLAGSLRSYIQYAEDIERRAAENRNKLFSKPDEKIEACKKAVRVLDLCIKISTRISAEFTDYFDSEDDYADYLEKYLKYQDDAIKELSGSSYAALDHFCNKDDLKFDIYVNAGQKPILQRNIVMAKLFGPDNILSEVMEKVTESAIREYYDYLKKVSGYRVRGKCSTEKEQEDLLKFQRLKNAVEFRDVTEYAEVINELLGQLISWSYLRERDLLYFQLGFHYMCLKNKSFKPAEYVDIRRNNGTIIHNAILYQIVSMYINGLDFYSCDKEGKTLKPIETGKGVGSKIGQFIKYSQYLYNDPSYKLEIYNAGLEVFENIDEHDNITDLRKYVDHFKYYAYGNKMSLLDLYSEFFDRFFTYDMKYQKNVVNVLENILLRHFVIFYPKFGSGKKDVGIRDCKKERAQIEISEQSLTSEDFMFKLDDKAGEEAKKFPARDERYLQTIAKLLYYPNEIEDMNRFMKKGETINKKVQFNRKKKITRKQKNNSSNEVLSSTMGYLFKNIKL

SEQ ID NO: 56 - protein, 500 aa, Chloroflexus aggregans
MTDQVRREEVAAGELADTPLAAAQTPAADAAVAATPAPAEAVAPTPEQAVDQPATTGESEAPVTTAQAAAHEAEPAEATGASFTPVSEQQPQKPRRLKDLQPGMELEGKVTSIALYGIFVDVGVGRDGLVHISEMSDRRIDTPSELVQIGDTVKVWVKSVDLDARRISLTMLNPSRGEKPRRSRQSQPAQPQPRRQEVDREKLASLKVGEIVEGVITGFAPFGAFADIGVGKDGLIHISELSEGRVEKPEDAVKVGERYQFKVLEIDGEGTRISLSLRRAQRTQRMQQLEPGQIIEGTVSGIATFGAFVDIGVGRDGLVHISALAPHRVAKVEDVVKVGDKVKVKVLGVDPQSKRISLTMRLEEEQPATTAGDEAAEPAEEVTPTRRGNLERFAAAAQTARERSERGERSERGERRERRERRPAQSSPDTYIVGEDDDESFEGNATIEDLLTKFGGSSSRRDRDRRRRHEDDDDEEMERPSNRRQREAIRRTLQQIGYDE

SEQ ID NO: 57 - protein, 249 aa, Demequina aurantiaca
MDLTWHALLILFIVALLAGFLDTLAGGGGLLTVPALLLTGIPPLQALGTNKLQSSFGTGMATYQVIRKKRVHWRDVRWPMVWAFLGSAAGAVAVQFIDTDALLIIIPVVLALVAAYFLFVPKSHLPPPEPRMSDPAYEATLVPIIGAYDGAFGPGTGSLYALSGVALRAKTLVQSTAIAKTLNFATNFAALLVFAFAGHMLWTVGAVMIAGQLIGAYAGSHMLFRVNPLVLRVLIVVMSLGMLIRVLLD

SEQ ID NO: 58 - protein, 1235 aa, Thalassospira species
MRIIKPYGRSHVEGVATQEPRRKLRLNSSPDISRDIPGFAQSHDALIIAQWISAIDKIATKPKPDKKPTQAQINLRTTLGDAAWQHVMAENLLPAATDPAIREKLHLIWQSKIAPWGTARPQAEKDGKPTPKGGWYERFCGVLSPEAITQNVARQIAKDIYDHLHVAAKRKGREPAKQGESSNKPGKFKPDRKRGLIEERAESIAKNALRPGSHAPCPWGPDDQATYEQAGDVAGQIYAAARDCLEEKKRRSGNRNTSSVQYLPRDLAAKILYAQYGRVFGPDTTIKAALDEQPSLFALHKAIKDCYHRLINDARKRDILRILPRNMAALFRLVRAQYDNRDINALIRLGKVIHYHASEQGKSEHHGIRDYWPSQQDIQNSRFWGSDGQADIKRHEAFSRIWRHIIALASRTLHDWADPHSQKFSGENDDILLLAKDAIEDDVFKAGHYERKCDVLFGAQASLFCGAEDFEKAILKQAITGTGNLRNATFHFKGKVRFEKELQELTKDVPVEVQSAIAALWQKDAEGRTRQIAETLQAVLAGHFLTEEQNRHIFAALTAAMAQPGDVPLPRLRRVLARHDSICQRGRILPLSPCPDRAKLEESPALTCQYTVLKMLYDGPFRAWLAQQNSTILNHYIDSTIARTDKAARDMNGRKLAQAEKDLITSRAADLPRLSVDEKMGDFLARLTAATATEMRVQRGYQSDGENAQKQAAFIGQFECDVIGRAFADFLNQSGFDFVLKLKADTPQPDAAQCDVTALIAPDDISVSPPQAWQQVLYFILHLVPVDDASHLLHQIRKWQVLEGKEKPAQIAHDVQSVLMLYLDMHDAKFTGGAALHGIEKFAEFFAHAADFRAVFPPQSLQDQDRSIPRRGLREIVRFGHLPLLQHMSGTVQITHDNVVAWQAARTAGATGMSPIARRQKQREELHALAVERTARFRNADLQNYMHALVDVIKHRQLSAQVTLSDQVRLHRLMMGVLGRLVDYAGLWERDLYFVVLALLYHHGATPDDVFKGQGKKNLADGQVVAALKPKNRKAAAPVGVFDDLDHYGIYQDDRQSIRNGLSHFNMLRGGKAPDLSHWVNQTRSLVAHDRKLKNAVAKSVIEMLAREGFDLDWGIQTDRGQHILSHGKIRTRQAQHFQKSRLHIVKKSAKPDKNDTVKIRENLHGDAMVERVVQLFAAQVQKRYDITVEKRLDHLFLKPQDQKGKNGIHTHNGWSKTEKKRRPSRENRKGNHEN

SEQ ID NO: 59 - protein, 1312 aa, Pseudobutyrivibrio species
MKFSKESHRKTAVGVTESNGIIGLLYKDPLNEKEKIEDVVNQRANSTKRLFNLFGTEATSKDISRASKDLAKVVNKAIGNLKGNKKFNKKEQITKGLNTKIIVEELKNVLKDEKKLIVNKDIIDEACSRLLKTSFRTAKTKQAVKMILTAVLIENTNLSKEDEAFVHEYFVKKLVNEYNKTSVKKQIPVALSNQNMVIQPNSVNGTLEISETKKSKETKTTEKDAFRAFLRDYATLDENRRHKMRLCLRNLVNLYFYGETSVSKDDFDEWRDHEDKKQNDELFVKKIVSIKTDRKGNVKEVLDVDATIDAIRTNNIACYRRALAYANENPDVFFSDTMLNKFWIHHVENEVERIYGHINNNTGDYKYQLGYLSEKVWKGIINYLSIKYIAEGKAVYNYAMNALAKDNNSNAFGKLDEKFVNGITSFEYERIKAEETLQRECAVNIAFAANHLANATVDLNEKDSDFLLLKHEDNKDTLGAVARPNILRNILQFFGGKSRWNDFDFSGIDEIQLLDDLRKMIYSLRNSSFHFKTENIDNDSWNTKLIGDMFAYDFNMAGNVQKDKMYSNNVPMFYSTSDIEKMLDRLYAEVHERASQVPSFNSVFVRKNFPDYLKNDLKITSAFGVDDALKWQSAVYYVCKEIYYNDFLQNPETFTMLKDYVQCLPIDIDKSMDQKLKSERNAHKNFKEAFATYCKECDSLSAICQMIMTEYNNQNKGNRKVISARTKDGDKLIYKHYKMILFEALKNVFTIYLEKNINTYGFLKKPKLINNVPAIEEFLPNYNGRQYETLVNRITEETELQKWYIVGRLLNPKQVNQLIGNFRSYVQYVNDVARRAKQTGNNLSNDNIAWDVKNIIQIFDVCTKLNGVTSNILEDYFDDGDDYARYLKNFVDYTNKNNDHSATLLGDFCAKEIDGIKIGIYHDGTNPIVNRNIIQCKLYGATGIISDLTKDGSILSVDYEIIKKYMQMQKEIKVYQQKGICKTKEEQQNLKKYQELKNIVELRNIIDYSEILDELQGQLINWGYLRERDLMYFQLGFHYLCLHNESKKPVGYNNAGDISGAVLYQIVAMYTNGLSLIDANGKSKKNAKASAGAKVGSFCSYSKEIRGVDKDTKEDDDPIYLAGVELFENINEHQQCINLRNYIEHFHYYAKHDRSMLDLYSEVFDRFFTYDMKYTKNVPNMMYNILLQHLVVPAFEFGSSEKRLDDNDEQTKPRAMFTLREKNGLSSEQFTYRLGDGNSTVKLSARGDDYLRAVASLLYYPDRAPEGLIRDAEAEDKFAKINHSNPKSDNRNNRGNFKNPKVQWYNNKTKRK

SEQ ID NO: 60 - protein, 1216 aa, Butyrivibrio species
LKKSFRVGNTKSALKKLLMAAYCGYKLSIEEKEEIQNYFVDKLVKEYNKDTVLKYTAKSLKHQNMVVQPDTDNHVFLPSRIAGATQNKMSEKEALTEFLKAYAVLDEEKRHNLRIILRKLVNLYFYESPDFIYPENNEWKEHDDRKNKTETFVSPVKVNEEKNGKTFVKIDVPATKDLIRLKNIECYRRSVAETAGNPITYFTDHNISKFWIHHIENEVEKIFALLKSNWKDYQFSVGYISEKVWKEIINYLSIKYIAIGKAVYNYALEDIKKNDGTLNFGVIDPSFYDGINSFEYEKIKAEETFQREVAVYVSFAVNHLSSATVKLSEAQSDMLVLNKNDIEKIAYGNTKRNILQFFGGQSKWKEFDFDRYINPVNYTDIDFLFDIKKMVYSLRNESFHFTTTDTESDWNKNLISAMFEYECRRISTVQKNKFFSNNLPLFYGENSLERVLHKLYDDYVDRMSQVPSFGNVFVRKKFPDYMKEIGIKHNLSSEDNLKLQGALYFLYKEIYYNAFISSEKAMKIFVDLVNKLDTNARDDKGRITHEAMAHKNFKDAISHYMTHDCSLADICQKIMTEYNQQNTGHRKKQTTYSSEKNPEIFRHYKMILFMLLQKAMTEYISSEEIFDFIMKPNSPKTDIKEEEFLPQYKSCAYDNLIKLIADNVELQKWYITARLLSPREVNQLIGSFRSYKQFVSDIERRAKETNNSLSKSGMTVDVENITKVLDLCTKLNGRFSNELTDYFDSKDDYAVYVSKFLDFGFKIDEKFPAALLGEFCNKEENGKKIGIYHNGTEPILNSNIIKSKLYGITDVVSRAVKPVSEKLIREYLQQEVKIKPYLENGVCKNKEEQAALRKYQELKNRIEFRDIVEYSEIINELMGQLINFSYLRERDLMYFQLGFHYLCLNNYGAKPEGYYSIVNDKRTIKGAILYQIVAMYTYGLPIYHYVDGTISDRRKNKKTVLDTLNSSETVGAKIKYFIYYSDELFNDSLILYNAGLELFENINEHENIVNLRKYIDHFKYYVSQDRSLLDIYSEVFDRYFTYDRKYKKNVMNLFSNIMLKHFIITDFEFSTGEKTIGEKNTAKKECAKVRIKRGGLSSDKFTYKFKDAKPIELSAKNTEFLDGVARILYYPENVVLTDLVRNSEVEDEKRIEKYDRNHNSSPTRKDKTYKQDVKKNYNKKTSKAFDSSKLDTKSVGNNLSDNPVLKQFLSESKKKR

SEQ ID NO: 61 - protein, 1276 aa, Blautia species; identical to SEQ ID NO: 53

SEQ ID NO: 62 - protein, 1168 aa, Leptotrichia species
MKITKIDGISHKKYIKEGKLVKSTSEENKTDERLSELLTIRLDTYIKNPDNASEEENRIRRENLKEFFSNKVLYLKDGILYLKDRREKNQLQNKNYSEEDISEYDLKNKNNFLVLKKILLNEDINSEELEIFRNDFEKKLDKINSLKYSLEENKANYQKINENNIKKVEGKSKRNIFYNYYKDSAKRNDYINNIQEAFDKLYKKEDIENLFFLIENSKKHEKYKIRECYHKIIGRKNDKENFATIIYEEIQNVNNMKELIEKVPNVSELKKSQVFYKYYLNKEKLNDENIKYVFCHFVEIEMSKLLKNYVYKKPSNISNDKVKRIFEYQSLKKLIENKLLNKLDTYVRNCGKYSFYLQDGEIATSDFIVGNRQNEAFLRNIIGVSSTAYFSLRNILETENENDITGRMRGKTVKNNKGEEKYISGEIDKLYDNNKQNEVKKNLKMFYSYDFNMNSKKEIEDFFSNIDEAISSIRHGIVHFNLELEGKDIFTFKNIVPSQISKKMFHDEINEKKLKLKIFKQLNSANVFRYLEKYKILNYLNRTRFEFVNKNIPFVPSFTKLYSRIDDLKNSLGIYWKTPKTNDDNKTKEITDAQIYLLKNIYYGEFLNYFMSNNGNFFEITKEIIELNKNDKRNLKTGFYKLQKFENLQEKTPKEYLANIQSLYMINAGNQDEEEKDTYIDFIQKIFLKGFMTYLANNGRLSLIYIGSDEETNTSLAEKKQEFDKFLKKYEQNNNIEIPYEINEFVREIKLGKILKYTERLNMFYLILKLLNHKELTNLKGSLEKYQSANKEEAFSDQLELINLLNLDNNRVTEDFELEADEIGKFLDFNGNKVKDNKELKKFDTNKIYFDGENIIKHRAFYNIKKYGMLNLLEKISDEAKYKISIEELKNYSKKKNEIEENHTTQENLHRKYARPRKDEKFTDEDYKKYEKAIRNIQQYTHLKNKVEFNELNLLQSLLLRILHRLVGYTSIWERDLRFRLKGEFPENQYIEEIFNFDNSKNVKYKNGQIVEKYINFYKELYKDDTEKISIYSDKKVKELKKEKKDLYIRNYIAHFNYIPNAEISLLEMLENLRKLLSYDRKLKNAIMKSIVDILKEYGFVVTFKIEKDKKIRIESLKSEEVVHLKKLKLKDNDKKKEPIKTYRNSKELCKLVKVMFEYKMKEKKSEN

SEQ ID NO: 63 - protein, 1138 aa, Bacteroides ihuae
MRITKVKVKESSDQKDKMVLIHRKVGEGTLVLDENLADLTAPIIDKYKDKSFELSLLKQTLVSEKEMNIPKCDKCTAKERCLSCKQREKRLKEVRGAIEKTIGAVIAGRDIIPRLNIFNEDEICWLIKPKLRNEFTFKDVNKQVVKLNLPKVLVEYSKKNDPTLFLAYQQWIAAYLKNKKGHIKKSILNNRVVIDYSDESKLSKRKQALELWGEEYETNQRIALESYHTSYNIGELVTLLPNPEEYVSDKGEIRPAFHYKLKNVLQMHQSTVFGTNEILCINPIFNENRANIQLSAYNLEVVKYFEHYFPIKKKKKNLSLNQAIYYLKVETLKERLSLQLENALRMNLLQKGKIKKHEFDKNTCSNTLSQIKRDEFFVLNLVEMCAFAANNIRNIVDKEQVNEILSKKDLCNSLSKNTIDKELCTKFYGADFSQIPVAIWAMRGSVQQIRNEIVHYKAEAIDKIFALKTFEYDDMEKDYSDTPFKQYLELSIEKIDSFFIEQLSSNDVLNYYCTEDVNKLLNKCKLSLRRTSIPFAPGFKTIYELGCHLQDSSNTYRIGHYLMLIGGRVANSTVTKASKAYPAYRFMLKLIYNHLFLNKFLDNHNKRFFMKAVAFVLKDNRENARNKFQYAFKEIRMMNNDESIASYMSYIHSLSVQEQEKKGDKNDKVRYNTEKFIEKVFVKGFDDFLSWLGVEFILSPNQEERDKTVTREEYENLMIKDRVEHSINSNQESHIAFFTFCKLLDANHLSDLRNEWIKFRSSGDKEGFSYNFAIDIIELCLLTVDRVEQRRDGYKEQTELKEYLSFFIKGNESENTVWKGFYFQQDNYTPVLYSPIELIRKYGTLELLKLIIVDEDKITQGEFEEWQTLKKVVEDKVTRRNELHQEWEDMKNKSSFSQEKCSIYQKLCRDIDRYNWLDNKLHLVHLRKLHNLVIQILSRMARFIALWDRDFVLLDASRANDDYKLLSFFNFRDFINAKKTKTDDELLAEFGSKIEKKNAPFIKAEDVPLMVECIEAKRSFYQKVFFRNNLQVLADRNFIAHYNYISKTAKCSLFEMIIKLRTLMYYDRKLRNAVVKSIANVFDQNGMVLQLSLDDSHELKVDKVISKRIVHLKNNNIMTDQVPEEYYKICRRLLEMKK

SEQ ID NO: 64 - protein, 697 aa, Porphyromonadaceae bacterium
MEFRDSIFKSLLQKEIEKAPLCFAEKLISGGVFSYYPSERLKEFVGNHPFSLFRKTMPFSPGFKRVMKSGGNYQNANRDGRFYDLDIGVYLPKDGFGDEEWNARYFLMKLIYNQLFLPYFADAENHLFRECVDFVKRVNRDYNCKNNNSEEQAFIDIRSMREDESIADYLAFIQSNIIIEENKKKETNKEGQINFNKFLLQVFVKGFDSFLKDRTELNFLQLPELQGDGTRGDDLESLDKLGAVVAVDLKLDATGIDADLNENISFYTFCKLLDSNHLSRLRNEIIKYQSANSDFSHNEDFDYDRIISIIELCMLSADHVSTNDNESIFPNNDKDFSGIRPYLSTDAKVETFEDLYVHSDAKTPITNATMVLNWKYGTDKLFERLMISDQDFLVTEKDYFVWKELKKDIEEKIKLREELHSLWVNTPKGKKGAKKKNGRETTGEFSEENKKEYLEVCREIDRYVNLDNKLHFVHLKRMHSLLIELLGRFVGFTYLFERDYQYYHLEIRSRRNKDAGVVDKLEYNKIKDQNKYDKDDFFACTFLYEKANKVRNFIAHFNYLTMWNSPQEEEHNSNLSGAKNSSGRQNLKCSLTELINELREVMSYDRKLKNAVTKAVIDLFDKHGMVIKFRIVNNNNNDNKNKHHLELDDIVPKKIMHLRGIKLKRQDGKPIPIQTDSVDPLYCRMWKKLLDLKPTPF

SEQ ID NO: 65 - protein, 204 aa, Listeria riparia
MHDAWAENPKKPQSDAFLKEYKACCEAIDTYNWHKNKATLVYVNELHHLLIDILGRLVGYVAIADRDFQCMANQYLKSSGHTERVDSWINTIRKNRPDYIEKLDIFMNKAGLFVSEKNGRNYIAHLNYLSPKHKYSLLYLFEKLREMLKYDRKLKNAVTKSLIDLLDKHGMCVVFANLKNNKHRLVIASLKPKKIETFKWKKIK

SEQ ID NO: 66 - protein, 1082 aa, Insolitispirillum peregrinum
MRIIRPYGSSTVASPSPQDAQPLRSLQRQNGTFDVAEFSRRHPELVLAQWVAMLDKIIRKPAPGKNSTALPRPTAEQRRLRQQVGAALWAEMQRHTPVPPELKAVWDSKVHPYSKDNAPATAKTPSHRGRWYDRFGDPETSAATVAEGVRRHLLDSAQPFRANGGQPKGKGVIEHRALTIQNGTLLHHHQSEKAGPLPEDWSTYRADELVSTIGKDARWIKVAASLYQHYGRIFGPTTPISEAQTRPEFVLHTAVKAYYRRLFKERKLPAERLERLLPRTGEALRHAVTVQHGNRSLADAVRIGKILHYGWLQNGEPDPWPDDAALYSSRYWGSDGQTDIKHSEAVSRVWRRALTAAQRTLTSWLYPAGTDAGDILLIGQKPDSIDRNRLPLLYGDSTRHWTRSPGDVWLFLKQTLENLRNSSFHFKTLSAFTSHLDGTCESEPAEQQAAQALWQDDRQQDHQQVFLSLRALDATTYLPTGPLHRIVNAVQSTDATLPLPRFRRVVTRAANTRLKGFPVEPVNRRTMEDDPLLRCRYGVLKLLYERGFRAWLETRPSIASCLDQSLKRSTKAAQTINGKNSPQGVEILSRATKLLQAEGGGGHGIHDLFDRLYAATAREMRVQVGYHHDAEAARQQAEFIEDLKCEVVARAFCAYLKTLGIQGDTFRRQPEPLPTWPDLPDLPSSTIGTAQAALYSVLHLMPVEDVGSLLHQLRRWLVALQARGGEDGTAITATIPLLELYLNRHDAKFSGGGAGTGLRWDDWQVFFDCQATFDRVFPPGPALDSHRLPLRGLREVLRFGRVNDLAALIGQDKITAAEVDRWHTAEQTIAAQQQRREALHEQLSRKKGTDAEVDEYRALVTAIADHRHLTAHVTLSNVVRLHRLMTTVLGRLVDYGGLWERDLTFVTLYEAHRLGGLRNLLSESRVNKFLDGQTPAALSKKNNAEENGMISKVLGDKARRQIRNDFAHFNMLQQGKKTINLTDEINNARKLMAHDRKLKNAITRSVTTLLQQDGLDIVWTMDASHRLTDAKIDSRNAIHLHKTHNRANIREPLHGKSYCRWVAALFGATSTPSATKKSDKIR

SEQ ID NO: 67 - protein, 1224 aa, Bergeyella zoohelcum
MENKTSLGNNIYYNPFKPQDKSYFAGYFNAAMENTDSVFRELGKRLKGKEYTSENFFDAIFKENISLVEYERYVKLLSDYFPMARLLDKKEVPIKERKENFKKNFKGIIKAVRDLRNFYTHKEHGEVEITDEIFGVLDEMLKSTVLTVKKKKVKTDKTKEILKKSIEKQLDILCQKKLEYLRDTARKIEEKRRNQRERGEKELVAPFKYSDKRDDLIAAIYNDAFDVYIDKKKDSLKESSKAKYNTKSDPQQEEGDLKIPISKNGVVFLLSLFLTKQEIHAFKSKIAGFKATVIDEATVSEATVSHGKNSICFMATHEIFSHLAYKKLKRKVRTAEINYGEAENAEQLSVYAKETLMMQMLDELSKVPDVVYQNLSEDVQKTFIEDWNEYLKENNGDVGTMEEEQVIHPVIRKRYEDKFNYFAIRFLDEFAQFPTLRFQVHLGNYLHDSRPKENLISDRRIKEKITVFGRLSELEHKKALFIKNTETNEDREHYWEIFPNPNYDFPKENISVNDKDFPIAGSILDREKQPVAGKIGIKVKLLNQQYVSEVDKAVKAHQLKQRKASKPSIQNIIEEIVPINESNPKEAIVFGGQPTAYLSMNDIHSILYEFFDKWEKKKEKLEKKGEKELRKEIGKELEKKIVGKIQAQIQQIIDKDTNAKILKPYQDGNSTAIDKEKLIKDLKQEQNILQKLKDEQTVREKEYNDFIAYQDKNREINKVRDRNHKQYLKDNLKRKYPEAPARKEVLYYREKGKVAVWLANDIKRFMPTDFKNEWKGEQHSLLQKSLAYYEQCKEELKNLLPEKVFQHLPFKLGGYFQQKYLYQFYTCYLDKRLEYISGLVQQAENFKSENKVFKKVENECFKFLKKQNYTHKELDARVQSILGYPIFLERGFMDEKPTIIKGKTFKGNEALFADWFRYYKEYQNFQTFYDTENYPLVELEKKQADRKRKTKIYQQKKNDVFTLLMAKHIFKSVFKQDSIDQFSLEDLYQSREERLGNQERARQTGERNTNYIWNKTVDLKLCDGKITVENVKLKNVGDFIKYEYDQRVQAFLKYEENIEWQAFLIKESKEEENYPYVVEREIEQYEKVRREELLKEVHLIEEYILEKVKDKEILKKGDNQNFKYYILNGLLKQLKNEDVESYKVFNLNTEPEDVNINQLKQEATDLEQKAFVLTYIRNKFAHNQLPKKEFWDYCQEKYGKIEKEKTYAEYFAEVFKKEKEALIK

SEQ ID NO: 68 - protein, 1126 aa, Prevotella intermedia
MEDDKKTTDSIRYELKDKHFWAAFLNLARHNVYITVNHINKILEEGEINRDGYETTLKNTWNEIKDINKKDRLSKLIIKHFPFLEAATYRLNPTDTTKQKEEKQAEAQSLESLRKSFFVFIYKLRDLRNHYSHYKHSKSLERPKFEEGLLEKMYNIFNASIRLVKEDYQYNKDINPDEDFKHLDRTEEEFNYYFTKDNEGNITESGLLFFVSLFLEKKDAIWMQQKLRGFKDNRENKKKMTNEVFCRSRMLLPKLRLQSTQTQDWILLDMLNELIRCPKSLYERLREEDREKFRVPIEIADEDYDAEQEPFKNTLVRHQDRFPYFALRYFDYNEIFTNLRFQIDLGTYHFSIYKKQIGDYKESHHLTHKLYGFERIQEFTKQNRPDEWRKFVKTFNSFETSKEPYIPETTPHYHLENQKIGIRFRNDNDKIWPSLKTNSEKNEKSKYKLDKSFQAEAFLSVHELLPMMFYYLLLKTENTDNDNEIETKKKENKNDKQEKHKIEEIIENKITEIYALYDTFANGEIKSIDELEEYCKGKDIEIGHLPKQMIAILKDEHKVMATEAERKQEEMLVDVQKSLESLDNQINEEIENVERKNSSLKSGKIASWLVNDMMRFQPVQKDNEGKPLNNSKANSTEYQLLQRTLAFFGSEHERLAPYFKQTKLIESSNPHPFLKDTEWEKCNNILSFYRSYLEAKKNFLESLKPEDWEKNQYFLKLKEPKTKPKTLVQGWKNGFNLPRGIFTEPIRKWFMKHRENITVAELKRVGLVAKVIPLFFSEEYKDSVQPFYNYHFNVGNINKPDEKNFLNCEERRELLRKKKDEFKKMTDKEKEENPSYLEFKSWNKFERELRLVRNQDIVTWLLCMELFNKKKIKELNVEKIYLKNINTNTTKKEKNTEEKNGEEKNIKEKNNILNRIMPMRLPIKVYGRENFSKNKKKKIRRNTFFTVYIEEKGTKLLKQGNFKALERDRRLGGLFSFVKTPSKAESKSNTISKLRVEYELGEYQKARIEIIKDMLALEKTLIDKYNSLDTDNFNKMLTDWLELKGEPDKASFQNDVDLLIAVRNAFSHNQYPMRNRIAFANINPFSLSSANTSEEKGLGIANQLKDKTHKTIEKIIEIEKPIETKE

SEQ ID NO: 69 - protein, 1127 aa, Prevotella buccae
MQKQDKLFVDRKKNAIFAFPKYITIMENKEKPEPIYYELTDKHFWAAFLNLARHNVYTTINHINRRLEIAELKDDGYMMGIKGSWNEQAKKLDKKVRLRDLIMKHFPFLEAAAYEMTNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYNAEEEPFKNTLVRHQDRFPYFVLRYFDLNEIFEQLRFQIDLGTYHFSIYNKRIGDEDEVRHLTHHLYGFARIQDFAPQNQPEEWRKLVKDLDHFETSQEPYISKTAPHYHLENEKIGIKFCSAHNNLFPSLQTDKTCNGRSKFNLGTQFTAEAFLSVHELLPMMFYYLLLTKDYSRKESADKVEGIIRKEISNIYAIYDAFANNEINSIADLTRRLQNTNILQGHLPKQMISILKGRQKDMGKEAERKIGEMIDDTQRRLDLLCKQTNQKIRIGKRNAGLLKSGKIADWLVNDMMRFQPVQKDQNNIPINNSKANSTEYRMLQRALALFGSENFRLKAYFNQMNLVGNDNPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNRLKPKKRQFLDKKERVELWQKNKELFKNYPSEKKKTDLAYLDFLSWKKFERELRLIKNQDIVTWLMFKELFNMATVEGLKIGEIHLRDIDTNTANEESNNILNRIMPMKLPVKTYETDNKGNILKERPLATFYIEETETKVLKQGNFKALVKDRRLNGLFSFAETTDLNLEEHPISKLSVDLELIKYQTTRISIFEMTLGLEKKLIDKYSTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 70 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFAVFFKPDDFVLAKNRKEQLISVADGKECLTVSGFAFFICLFLDREQASGMLSRIRGFKRTDENWARAVHETFCDLCIRHPHDRLESSNTKEALLLDMLNELNRCPRILYDMLPEEERAQFLPALDENSMNNLSENSLDEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELRLLDPSSGHPFLSATMETAHRYTEGFYKCYLEKKREWLAKIFYRPEQDENTKRRISVFFVPDGEARKLLPLLIRRRMKEQNDLQDWIRNKQAHPIDLPSHLFDSKVMELLKVKDGKKKWNEAFKDWWSTKYPDGMQPFYGLRRELNIHGKSVSYIPSDGKKFADCYTHLMEKTVRDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 71 - protein, 1115 aa, Bacteroides pyogenes
MESIKNSQKSTGKTLQKDPPYFGLYLNMALLNVRKVENHIRKWLGDVALLPEKSGFHSLLTTDNLSSAKWTRFYYKSRKFLPFLEMFDSDKKSYENRRETAECLDTIDRQKISSLLKEVYGKLQDIRNAFSHYHIDDQSVKHTALIISSEMHRFIENAYSFALQKTRARFTGVFVETDFLQAEEKGDNKKFFAIGGNEGIKLKDNALIFLICLFLDREEAFKFLSRATGFKSTKEKGFLAVRETFCALCCRQPHERLLSVNPREALLMDMLNELNRCPDILFEMLDEKDQKSFLPLLGEEEQAHILENSLNDELCEAIDDPFEMIASLSKRVRYKNRFPYLMLRYIEEKNLLPFIRFRIDLGCLELASYPKKMGEENNYERSVTDHAMAFGRLTDFHNEDAVLQQITKGITDEVRFSLYAPRYAIYNNKIGFVRTSGSDKISFPTLKKKGGEGHCVAYTLQNTKSFGFISIYDLRKILLLSFLDKDKAKNIVSGLLEQCEKHWKDLSENLFDAIRTELQKEFPVPLIRYTLPRSKGGKLVSSKLADKQEKYESEFERRKEKLTEILSEKDFDLSQIPRRMIDEWLNVLPTSREKKLKGYVETLKLDCRERLRVFEKREKGEHPLPPRIGEMATDLAKDIIRMVIDQGVKQRITSAYYSEIQRCLAQYAGDDNRRHLDSIIRELRLKDTKNGHPFLGKVLRPGLGHTEKLYQRYFEEKKEWLEATFYPAASPKRVPRFVNPPTGKQKELPLIIRNLMKERPEWRDWKQRKNSHPIDLPSQLFENEICRLLKDKIGKEPSGKLKWNEMFKLYWDKEFPNGMQRFYRCKRRVEVFDKVVEYEYSEEGGNYKKYYEALIDEVVRQKISSSKEKSKLQVEDLTLSVRRVFKRAINEKEYQLRLLCEDDRLLFMAVRDLYDWKEAQLDLDKIDNMLGEPVSVSQVIQLEGGQPDAVIKAECKLKDVSKLMRYCYDGRVKGLMPYFANHEATQEQVEMELRHYEDHRRRVFNWVFALEKSVLKNEKLRRFYEESQGGCEHRRCIDALRKASLVSEEEYEFLVHIRNKSAHNQFPDLEIGKLPPNVTSGFCECIWSKYKAIICRIIPFIDPERRFFGKLLEQK

SEQ ID NO: 72 - protein, 953 aa, Alistipes species
MSNEIGAFREHQFAYAPGNEKQEEATFATYFNLALSNVEGMMFGEVESNPDKIEKSLDTLPPAILRQIASFIWLSKEDHPDKAYSTEEVKVIVTDLVRRLCFYRNYFSHCFYLDTQYFYSDELVDTTAIGEKLPYNFHHFITNRLFRYSLPEITLFRWNEGERKYEILRDGLIFFCCLFLKRGQAERFLNELRFFKRTDEEGRIKRTIFTKYCTRESHKHIGIEEQDFLIFQDIIGDLNRVPKVCDGVVDLSKENERYIKNRETSNESDENKARYRLLIREKDKFPYYLMRYIVDFGVLPCITFKQNDYSTKEGRGQFHYQDAAVAQEERCYNFVVRNGNVYYSYMPQAQNVVRISELQGTISVEELRNMVYASINGKDVNKSVEQYLYHLHLLYEKILTISGQTIKEGRVDVEDYRPLLDKLLLRPASNGEELRRELRKLLPKRVCDLLSNRFDCSEGVSAVEKRLKAILLRHEQLLLSQNPALHIDKIKSVIDYLYLFFSDDEKFRQQPTEKAHRGLKDEEFQMYHYLVGDYDSHPLALWKELEASGRLKPEMRKLTSATSLHGLYMLCLKGTVEWCRKQLMSIGKGTAKVEAIADRVGLKLYDKLKEYTPEQLEREVKLVVMHGYAAAATPKPKAQAAIPSKLTELRFYSFLGKREMSFAAFIRQDKKAQKLWLRNFYTVENIKTLQKRQAAADAACKKLYNLVGEVERVHTNDKVLVLVAQRYRERLLNVGSKCAVTLDNPERQQKLADVYEVQNAWLSIRFDDLDFTLTHVNLSNLRKAYNLIPRKHILAFKEYLDNRVKQKLCEECRNVRRKEDLCTCCSPRYSNLTSWLKENHSESSIEREAATMMLLDVERKLLSFLLDERRKAIIEYGKFIPFSALVKECRLADAGLCGIRNDVLHDNVISYADAIGKLSAYFPKEASEAVEYIRRTKEVREQRREELMANSSQ

SEQ ID NO: 73 - protein, 1322 aa, Prevotella species
MSKECKKQRQEKKRRLQKANFSISLTGKHVFGAYFNMARTNFVKTINYILPIAGVRGNYSENQINKMLHALFLIQAGRNEELTTEQKQWEKKLRLNPEQQTKFQKLLFKHFPVLGPMMADVADHKAYLNKKKSTVQTEDETFAMLKGVSLADCLDIICLMADTLTECRNFYTHKDPYNKPSQLADQYLHQEMIAKKLDKVVVASRRILKDREGLSVNEVEFLTGIDHLHQEVLKDEFGNAKVKDGKVMKTFVEYDDFYFKISGKRLVNGYTVTTKDDKPVNVNTMLPALSDFGLLYFCVLFLSKPYAKLFIDEVRLFEYSPFDDKENMIMSEMLSIYRIRTPRLHKIDSHDSKATLAMDIFGELRRCPMELYNLLDKNAGQPFFHDEVKHPNSHTPDVSKRLRYDDRFPTLALRYIDETELFKRIRFQLQLGSFRYKFYDKENCIDGRVRVRRIQKEINGYGRMQEVADKRMDKWGDLIQKREERSVKLEHEELYINLDQFLEDTADSTPYVTDRRPAYNIHANRIGLYWEDSQNPKQYKVFDENGMYIPELVVTEDKKAPIKMPAPRCALSVYDLPAMLFYEYLREQQDNEFPSAEQVIIEYEDDYRKFFKAVAEGKLKPFKRPKEFRDFLKKEYPKLRMADIPKKLQLFLCSHGLCYNNKPETVYERLDRLTLQHLEERELHIQNRLEHYQKDRDMIGNKDNQYGKKSFSDVRHGALARYLAQSMMEWQPTKLKDKEKGHDKLTGLNYNVLTAYLATYGHPQVPEEGFTPRTLEQVLINAHLIGGSNPHPFINKVLALGNRNIEELYLHYLEEELKHIRSRIQSLSSNPSDKALSALPFIHHDRMRYHERTSEEMMALAARYTTIQLPDGLFTPYILEILQKHYTENSDLQNALSQDVPVKLNPTCNAAYLITLFYQTVLKDNAQPFYLSDKTYTRNKDGEKAESFSFKRAYELFSVLNNNKKDTFPFEMIPLFLTSDEIQERLSAKLLDGDGNPVPEVGEKGKPATDSQGNTIWKRRIYSEVDDYAEKLTDRDMKISFKGEWEKLPRWKQDKIIKRRDETRRQMRDELLQRMPRYIRDIKDNERTLRRYKTQDMVLFLLAEKMFTNIISEQSSEFNWKQMRLSKVCNEAFLRQTLTFRVPVTVGETTIYVEQENMSLKNYGEFYRFLTDDRLMSLLNNIVETLKPNENGDLVIRHTDLMSELAAYDQYRSTIFMLIQSIENLIITNNAVLDDPDADGFWVREDLPKRNNFASLLELINQLNNVELTDDERKLLVAIRNAFSHNSYNIDFSLIKDVKHLPEVAKGILQHLQSMLGVEITK

SEQ ID NO: 74 - protein, 1322 aa, Prevotella species; identical to SEQ ID NO: 73

SEQ ID NO: 75 - protein, 1095 aa, Riemerella anatipestifer
MEKPLLPNVYTLKHKFFWGAFLNIARHNAFITICHINEQLGLKTPSNDDKIVDVVCETWNNILNNDHDLLKKSQLTELILKHFPFLTAMCYHPPKKEGKKKGHQKEQQKEKESEAQSQAEALNPSKLIEALEILVNQLHSLRNYYSHYKHKKPDAEKDIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSEDLMLSKPIRKEIKKHGRVGFISRAITLYFKEKYQDKHQSFYNLSYKLEAKAPLLKREEHYEYWQQNKPQSPTESQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYHKTPIRTVYIREEHTKALKMGNFKALVKDRRLNGLFSFIKEENDTQKHPISQLRLRRELEIYQSLRVDAFKETLSLEEKLLNKHTSLSSLENEFRALLEEWKKEYAASSMVTDEHIAFIASVRNAFCHNQYPFYKEALHAPIPLFTVAQPTTEEKDGLGIAEALLKVLREYCEIVKSQI

SEQ ID NO: 76 - protein, 1124 aa, Prevotella aurantiaca
MEDDKKTTGSISYELKDKHFWAAFLNLARHNVYITINHINKLLEIREIDNDEKVLDIKTLWQKGNKDLNQKARLRELMTKHFPFLETAIYTKNKEDKKEVKQEKQAEAQSLESLKDCLFLFLDKLQEARNYYSHYKYSEFSKEPEFEEGLLEKMYNIFGNNIQLVINDYQHNKDINPDEDFKHLDRKGQFKYSFADNEGNITESGLLFFVSLFLEKKDAIWMQQKLNGFKDNLENKKKMTHEVFCRSRILMPKLRLESTQTQDWILLDMLNELIRCPKSLYERLQGDDREKFKVPFDPADEDYNAEQEPFKNTLIRHQDRFPYFVLRYFDYNEIFKNLRFQIDLGTYHFSIYKKLIGGQKEDRHLTHKLYGFERIQEFAKQNRPDEWKAIVKDLDTYETSNKRYISETTPHYHLENQKIGIRFRNGNKEIWPSLKTNDENNEKSKYKLDKQYQAEAFLSVHELLPMMFYYLLLKKEKPNNDEINASIVEGFIKREIRNIFKLYDAFANGEINNIDDLEKYCADKGIPKRHLPKQMVAILYDEHKDMVKEAKRKQKEMVKDTKKLLATLEKQTQKEKEDDGRNVKLLKSGEIARWLVNDMMRFQPVQKDNEGKPLNNSKANSTEYQMLQRSLALYNNEEKPTRYFRQVNLIESNNPHPFLKWTKWEECNNILTFYYSYLTKKIEFLNKLKPEDWKKNQYFLKLKEPKTNRETLVQGWKNGFNLPRGIFTEPIREWFKRHQNNSKEYEKVEALDRVGLVTKVIPLFFKEEYFKDKEENFKEDTQKEINDCVQPFYNFPYNVGNIHKPKEKDFLHREERIELWDKKKDKFKGYKEKIKSKKLTEKDKEEFRSYLEFQSWNKFERELRLVRNQDIVTWLLCKELIDKLKIDELNIEELKKLRLNNIDTDTAKKEKNNILNRVMPMELPVTVYEIDDSHKIVKDKPLHTIYIKEAETKLLKQGNFKALVKDRRLNGLFSFVKTNSEAESKRNPISKLRVEYELGEYQEARIEIIQDMLALEEKLINKYKDLPTNKFSEMLNSWLEGKDEADKARFQNDVDFLIAVRNAFSHNQYPMHNKIEFANIKPFSLYTANNSEEKGLGIANQLKDKTKETTDKIKKIEKPIETKE

SEQ ID NO: 77 - protein, 1151 aa, Prevotella saccharolytica
MEDKPFWAAFFNLARHNVYLTVNHINKLLDLEKLYDEGKHKEIFEREDIFNISDDVMNDANSNGKKRKLDIKKIWDDLDTDLTRKYQLRELILKHFPFIQPAIIGAQTKERTTIDKDKRSTSTSNDSLKQTGEGDINDLLSLSNVKSMFFRLLQILEQLRNYYSHVKHSKSATMPNFDEDLLNWMRYIFIDSVNKVKEDYSSNSVIDPNTSFSHLIYKDEQGKIKPCRYPFTSKDGSINAFGLLFFVSLFLEKQDSIWMQKKIPGFKKASENYMKMTNEVFCRNHILLPKIRLETVYDKDWMLLDMLNEVVRCPLSLYKRLTPAAQNKFKVPEKSSDNANRQEDDNPFSRILVRHQNRFPYFVLRFFDLNEVFTTLRFQINLGCYHFAICKKQIGDKKEVHHLIRTLYGFSRLQNFTQNTRPEEWNTLVKTTEPSSGNDGKTVQGVPLPYISYTIPHYQIENEKIGIKIFDGDTAVDTDIWPSVSTEKQLNKPDKYTLTPGFKADVFLSVHELLPMMFYYQLLLCEGMLKTDAGNAVEKVLIDTRNAIFNLYDAFVQEKINTITDLENYLQDKPILIGHLPKQMIDLLKGHQRDMLKAVEQKKAMLIKDTERRLKLLDKQLKQETDVAAKNTGTLLKNGQIADWLVNDMMRFQPVKRDKEGNPINCSKANSTEYQMLQRAFAFYATDSCRLSRYFTQLHLIHSDNSHLFLSRFEYDKQPNLIAFYAAYLKAKLEFLNELQPQNWASDNYFLLLRAPKNDRQKLAEGWKNGFNLPRGLFTEKIKTWFNEHKTIVDISDCDIFKNRVGQVARLIPVFFDKKFKDHSQPFYRYDFNVGNVSKPTEANYLSKGKREELFKSYQNKFKNNIPAEKTKEYREYKNFSLWKKFERELRLIKNQDILIWLMCKNLFDEKIKPKKDILEPRIAVSYIKLDSLQTNTSTAGSLNALAKVVPMTLAIHIDSPKPKGKAGNNEKENKEFTVYIKEEGTKLLKWGNFKTLLADRRIKGLFSYIEHDDIDLKQHPLTKRRVDLELDLYQTCRIDIFQQTLGLEAQLLDKYSDLNTDNFYQMLIGWRKKEGIPRNIKEDTDFLKDVRNAFSHNQYPDSKKIAFRRIRKFNPKELILEEEEGLGIATQMYKEVEKVVNRIKRIELFD

SEQ ID NO: 78 - protein, 1159 aa, Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSDIVIENKVLDFLNSSFVSTALHVKDKYLKTDKTKEFLKETIAAELDILIEAYKKKQIEKKNTRFKANKREDILNAIYNEAFWSFINDKDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHTELQKLFAYFDTSKSDLELILSNMVMVKDYPIELIDLVKKSRTLVDFLNKYLEARLEYIENVITRVKNSIGTPQFKTVRKECFTFLKKSNYTVVSLDKQVERILSMPLFIERGFMDDKPTMLEGKSYKQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCDGLVHIDNVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLLPIGMDVREMLILSTDVKFKKEEIIQLGQAGEVEQDLYSLIYIRNKFAHNQLPIKEFFDFCENNYRSISDNEYYAEYYMEIFRSIKEKYAN

SEQ ID NO: 79 - protein, 1120 aa, Prevotella intermedia
MEDDKKTTDSIRYELKDKHFWAAFLNLARHNVYITVNHINKILEEDEINRDGYENTLENSWNEIKDINKKDRLSKLIIKHFPFLEATTYRQNPTDTTKQKEEKQAEAQSLESLKKSFFVFIYKLRDLRNHYSHYKHSKSLERPKFEEDLQNKMYNIFDVSIQFVKEDYKHNTDINPKKDFKHLDRKRKGKFHYSFADNEGNITESGLLFFVSLFLEKKDAIWVQKKLEGFKCSNKSYQKMTNEVFCRSRMLLPKLRLESTQTQDWILLDMLNELIRCPKSLYERLQGVNRKKFYVSFDPADEDYDAEQEPFKNTLVRHQDRFPYFALRYFDYNEVFANLRFQIDLGTYHFSIYKKLIGGQKEDRHLTHKLYGFERIQEFDKQNRPDEWKAIVKDSDTFKKKEEKEEEKPYISETTPHYHLENKKIGIAFKNHNIWPSTQTELTNNKRKKYNLGTSIKAEAFLSVHELLPMMFYYLLLKTENTKNDNKVGGKKETKKQGKHKIEAIIESKIKDIYALYDAFANGEINSEDELKEYLKGKDIKIVHLPKQMIAILKNEHKDMAEKAEAKQEKMKLATENRLKTLDKQLKGKIQNGKRYNSAPKSGEIASWLVNDMMRFQPVQKDENGESLNNSKANSTEYQLLQRTLAFFGSEHERLAPYFKQTKLIESSNPHPFLNDTEWEKCSNILSFYRSYLKARKNFLESLKPEDWEKNQYFLMLKEPKTNRETLVQGWKNGFNLPRGFFTEPIRKWFMEHWKSIKVDDLKRVGLVAKVTPLFFSEKYKDSVQPFYNYPFNVGDVNKPKEEDFLHREERIELWDKKKDKFKGYKAKKKFKEMTDKEKEEHRSYLEFQSWNKFERELRLVRNQDIVTWLLCTELIDKLKIDELNIKELKKLRLKDINTDTAKKEKNNILNRVMPMELPVTVYKVNKGGYIIKNKPLHTIYIKEAETKLLKQGNFKALVKDRRLNGLFSFVKTPSEAESESNPISKLRVEYELGKYQNARLDIIEDMLALEKKLIDKYNSLDTDNFHNMLTGWLELKGEAKKARFQNDVKLLTAVRNAFSHNQYPMYDENLFGNIERFSLSSSNIIESKGLDIAAKLKEEVSKAAKKIQNEEDNKKEKET

SEQ ID NO: 80 - protein, 1199 aa, Capnocytophaga canimorsus
MKNIQRLGKGNEFSPFKKEDKFYFGGFLNLANNNIEDFFKEIITRFGIVITDENKKPKETFGEKILNEIFKKDISIVDYEKWVNIFADYFPFTKYLSLYLEEMQFKNRVICFRDVMKELLKTVEALRNFYTHYDHEPIKIEDRVFYFLDKVLLDVSLTVKNKYLKTDKTKEFLNQHIGEELKELCKQRKDYLVGKGKRIDKESEIINGIYNNAFKDFICKREKQDDKENHNSVEKILCNKEPQNKKQKSSATVWELCSKSSSKYTEKSFPNRENDKHCLEVPISQKGIVFLLSFFLNKGEIYALTSNIKGFKAKITKEEPVTYDKNSIRYMATHRMFSFLAYKGLKRKIRTSEINYNEDGQASSTYEKETLMLQMLDELNKVPDVVYQNLSEDVQKTFIEDWNEYLKENNGDVGTMEEEQVIHPVIRKRYEDKFNYFAIRFLDEFAQFPTLRFQVHLGNYLCDKRTKQICDTTTEREVKKKITVFGRLSELENKKAIFLNEREEIKGWEVFPNPSYDFPKENISVNYKDFPIVGSILDREKQPVSNKIGIRVKIADELQREIDKAIKEKKLRNPKNRKANQDEKQKERLVNEIVSTNSNEQGEPVVFIGQPTAYLSMNDIHSVLYEFLINKISGEALETKIVEKIETQIKQIIGKDATTKILKPYTNANSNSINREKLLRDLEQEQQILKTLLEEQQQREKDKKDKKSKRKHELYPSEKGKVAVWLANDIKRFMPKAFKEQWRGYHHSLLQKYLAYYEQSKEELKNLLPKEVFKHFPFKLKGYFQQQYLNQFYTDYLKRRLSYVNELLLNIQNFKNDKDALKATEKECFKFFRKQNYIINPINIQIQSILVYPIFLKRGFLDEKPTMIDREKFKENKDTELADWFMHYKNYKEDNYQKFYAYPLEKVEEKEKFKRNKQINKQKKNDVYTLMMVEYIIQKIFGDKFVEENPLVLKGIFQSKAERQQNNTHAATTQERNLNGILNQPKDIKIQGKITVKGVKLKDIGNFRKYEIDQRVNTFLDYEPRKEWMAYLPNDWKEKEKQGQLPPNNVIDRQISKYETVRSKILLKDVQELEKIISDEIKEEHRHDLKQGKYYNFKYYILNGLLRQLKNENVENYKVFKLNTNPEKVNITQLKQEATDLEQKAFVLTYIRNKFAHNQLPKKEFWDYCQEKYGKIEKEKTYAEYFAEVFKREKEALIK

SEQ ID NO: 81 - protein, 1175 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKIDHEHNDEVDPHYHFNHLVRKGKKDRYGHNDNPSFKHHFVDGEGMVTEAGLLFFVSLFLEKRDAIWMQKKIRGFKGGTETYQQMTNEVFCRSRISLPKLKLESLRMDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAERVQGRIKRVIEDVYAVYDAFARDEINTRDELDACLADKGIRRGHLPRQMIAILSQEHKDMEEKIRKKLQEMMADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHETRWESHTNILSFYRSYLRARKAFLERIGRSDRVENRPFLLLKEPKTDRQTLVAGWKGEFHLPRGIFTEAVRDCLIEMGHDEVASYKEVGFMAKAVPLYFERACEDRVQPFYDSPFNVGNSLKPKKGRFLSKEERAEEWERGKERFRDLEAWSYSAARRIEDAFAGIEYASPGNKKKIEQLLRDLSLWEAFESKLKVRADRINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 82 - protein, 1090 aa, Prevotella species
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLNDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEAETMRKQENGTFGNSGIRIRDFENMKRDDANPANYPYIVDTYTHYILENNKVEMFINDKEDSAPLLPVIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVEFYERYLIERKFYLTGLSNEIKKGNRVDVPFIRRDQNKWKTPAMKTLGRIYSEDLPVELPRQMFDNEIKSHLKSLPQMEGIDFNNANVTYLIAEYMKRVLDDDFQTFYQWNRNYRYMDMLKGEYDRKGSLQHCFTSVEEREGLWKERASRTERYRKQASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGVVEIKALPEIAMSIKKAFGEYAIMK

SEQ ID NO: 83 - protein, 1150 aa, Flavobacterium branchiophilum
MENLNKILDKENEICISKIFNTKGIAAPITEKALDNIKSKQKNDLNKEARLHYFSIGHSFKQIDTKKVFDYVLIEELKDEKPLKFITLQKDFFTKEFSIKLQKLINSIRNINNHYVHNFNDINLNKIDSNVFHFLKESFELAIIEKYYKVNKKYPLDNEIVLFLKELFIKDENTALLNYFTNLSKDEAIEYILTFTITENKIWNINNEHNILNIEKGKYLTFEAMLFLITIFLYKNEANHLLPKLYDFKNNKSKQELFTFFSKKFTSQDIDAEEGHLIKFRDMIQYLNHYPTAWNNDLKLESENKNKIMTTKLIDSIIEFELNSNYPSFATDIQFKKEAKAFLFASNKKRNQTSFSNKSYNEEIRHNPHIKQYRDEIASALTPISFNVKEDKFKIFVKKHVLEEYFPNSIGYEKFLEYNDFTEKEKEDFGLKLYSNPKTNKLIERIDNHKLVKSHGRNQDRFMDFSMRFLAENNYFGKDAFFKCYKFYDTQEQDEFLQSNENNDDVKFHKGKVTTYIKYEEHLKNYSYWDCPFVEENNSMSVKISIGSEEKILKIQRNLMIYFLENALYNENVENQGYKLVNNYYRELKKDVEESIASLDLIKSNPDFKSKYKKILPKRLLHNYAPAKQDKAPENAFETLLKKADFREEQYKKLLKKAEHEKNKEDFVKRNKGKQFKLHFIRKACQMMYFKEKYNTLKEGNAAFEKKDPVIEKRKNKEHEFGHHKNLNITREEFNDYCKWMFAFNGNDSYKKYLRDLFSEKHFFDNQEYKNLFESSVNLEAFYAKTKELFKKWIETNKPTNNENRYTLENYKNLILQKQVFINVYHFSKYLIDKNLLNSENNVIQYKSLENVEYLISDFYFQSKLSIDQYKTCGKLFNKLKSNKLEDCLLYEIAYNYIDKKNVHKIDIQKILTSKIILTINDANTPYKISVPFNKLERYTEMIAIKNQNNLKARFLIDLPLYLSKNKIKKGKDSAGYEIIIKNDLEIEDINTINNKIINDSVKFTEVLMELEKYFILKDKCILSKNYIDNSEIPSLKQFSKVWIKENENEIINYRNIACHFHLPLLETFDNLLLNVEQKFIKEELQNVSTINDLSKPQEYLILLFIKFKHNNFYLNLFNKNESKTIKNDKEVKKNRVLQKFINQVILKKK

SEQ ID NO: 84 - protein, 1159 aa, Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSDIVIENKVLDFLNSSFVSTALHVKDKYLKTDKTKEFLKETIAAELDILIEAYKKKQIEKKNTRFKANKREDILNAIYNEAFWSFINDKDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVTHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHIELQKLFAYFDTSKSDLELILSNMVMVKDYPIELIDLVKKSRTLVDFLNKYLEARLEYIENVITRVKNSIGTPQFKTVRKECFTFLKKSNYTVVSLDKQVERILSMPLFIERGFMDDKPTMLEGKSYKQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCDGLVHIDNVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLLPIGMDVREMLILSTDVKFKKEEIIQLGQAGEVEQDLYSLIYIRNKFAHNQLPIKEFFDFCENNYRSISDNEYYAEYYMEIFRSIKEKYAN

SEQ ID NO: 85 - protein, 1214 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKIYDFLDDTLLDVLITIKKKKVKNDTSRELLKEKLRPELTQLKNQKREELIKKGKKLLEENLENAVFNHCLIPFLEENKTDDKQNKTVSLRKYRKSKPNEETSITLTQSGLVFLMSFFLHRKEFQVFTSGLERFKAKVNTIKEEEISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLSLVTEYKKNVYLKETSNIDLSRFPLFPNPSYVMANNNIPFYIDSRSNNLDEYLNQKKKAQSQNKKRNLTFEKYNKEQSKDAIIAMLQKEIGVKDLQQRSTIGLLSCNELPSMLYEVIVKDIKGAELENKIAQKIREQYQSIRDFTLDSPQKDNIPTTLIKTINTDSSVTFENQPIDIPRLKNALQKELTLTQEKLLNVKEHEIEVDNYNRNKNTYKFKNQPKNKVDDKKLQRKYVFYRNEIRQEANWLASDLIHFMKNKSLWKGYMHNELQSFLAFFEDKKNDCIALLETVFNLKEDCILTKGLKNLFLKHGNFIDFYKEYLKLKEDFLSTESTFLENGFIGLPPKILKKELSKRLKYIFIVFQKRQFIIKELEEKKNNLYADAINLSRGIFDEKPTMIPFKKPNPDEFASWFVASYQYNNYQSFYELTPDIVERDKKKKYKNLRAINKVKIQDYYLKLMVDTLYQDLFNQPLDKSLSDFYVSKAEREKIKADAKAYQKLNDSSLWNKVIHLSLQNNRITANPKLKDIGKYKRALQDEKIATLLTYDARTWTYALQKPEKENENDYKELHYTALNMELQEYEKVRSKELLKQVQELEKKILDKFYDFSNNASHPEDLEIEDKKGKRHPNFKLYITKALLKNESEIINLENIDIEILLKYYDYNTEELKEKIKNMDEDEKAKIINTKENYNKITNVLIKKALVLIIIRNKMAHNQYPPKFIYDLANRFVPKKEEEYFATYFNRVFETITKELWENKEKKDKTQV

SEQ ID NO: 86 - protein, 1119 aa, Porphyromonas gingivalis
MTEQNEKPYNGTYYTLEDKHFWAAFLNLARHNAYITLAHIDRQLAYSKADITNDEDILFFKGQWKNLDNDLERKARLRSLILKHFSFLEGAAYGKKLFESQSSGNKSSKKKELSKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREGTVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVVADWLVRDMMRFQPVAKDTSGKPLNNSKANSTEYRMLQRALALFGGEKERLTPYFRQMNLTGGNNPHPFLHETRWESHTNILSFYRSYLEARKAFLQSIGRSDRVENHRFLLLKEPKTDRQTLVAGWKGEFHLPRGIFTEAVRDCLIEMGYDEVGSYKEVGFMAKAVPLYFERASKDRVQPFYDYPFNVGNSLKPKKGRFLSKEKRAEEWESGKERFRLAKLKKEILEAKEHPYHDFKSWQKFERELRLVKNQDIITWMMCRDLMEENKVEGLDTGTLYLKDIRTDVQEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDETLFSSIRKYDPSSPDAIEERMGLNIAHRLSEEVKQAKEMVERIIQA

SEQ ID NO: 87 - protein, 1175 aa, Porphyromonas species
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRTDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIGILSQERKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKGEFHLPRGIFTEAVRDCLIEMGYDEVGSYREVGFMAKAVPLYFERACEDRVQPFYDSPFNVGNSLKPKKGRFLSKEDRAEEWERGKERFRDLEAWSHSAARRIKDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 88 - protein, 1132 aa, Prevotella intermedia
MEDDKKTKESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAKAQSFDSLKHCLFLFLEKLQEARNYYSHYKYSESTKEPMLEKELLKKMYNIFDDNIQLVIKDYQHNKDINPDEDFKHLDRTEEEFNYYFTTNKKGNITASGLLFFVSLFLEKKDAIWMQQKLRGFKDNRESKKKMTHEVFCRSRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRTDEWKAIVKDFDTYETSEEPYISETAPHYHLENQKIGIRFRNDNDEIWPSLKTNGENNEKRKYKLDKQYQAEAFLSVHELLPMMFYYLLLKKEEPNNDKKNASIVEGFIKREIRDIYKLYDAFANGEINNIDDLEKYCEDKGIPKRHLPKQMVAILYDEHKDMAEEAKRKQKEMVKDTKKLLATLEKQTQGEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSEEYEKVETLDRVGLVTKVIPLFFKKEDSKDKEEYLKKDAQKEINNCVQPFYGFPYNVGNIHKPDEKDFLPSEERKKLWGDKKYKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSETELKSNPISKSLVEYELGEYQNARIETIKDMLLLEETLIEKYKTLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 89 - protein, 1134 aa, Prevotella intermedia
MKMEDDKKTKESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAKAQSFDSLKHCLFLFLEKLQEARNYYSHYKYSESTKEPMLEKELLKKMYNIFDDNIQLVIKDYQHNKDINPDEDFKHLDRTEEEFNYYFTTNKKGNITASGLLFFVSLFLEKKDAIWMQQKLRGFKDNRESKKKMTHEVFCRSRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRTDEWKAIVKDFDTYETSEEPYISETAPHYHLENQKIGIRFRNDNDEIWPSLKTNGENNEKRKYKLDKQYQAEAFLSVHELLPMMFYYLLLKKEEPNNDKKNASIVEGFIKREIRDIYKLYDAFANGEINNIDDLEKYCEDKGIPKRHLPKQMVAILYDEHKDMAEEAKRKQKEMVKDTKKLLATLEKQTQGEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSEEYEKVETLDRVGLVTKVIPLFFKKEDSKDKEEYLKKDAQKEINNCVQPFYGFPYNVGNIHKPDEKDFLPSEERKKLWGDKKYKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSETELKSNPISKSLVEYELGEYQNARIETIKDMLLLEETLIEKYKTLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 90 - protein, 1133 aa, Prevotella intermedia
MEDDKKTTDSISYELKDKHFWAAFLNLARHNVYITVNHINKVLELKNKKDQDIIIDNDQDILAIKTHWEKVNGDLNKTERLRELMTKHFPFLETAIYSKNKEDKEEVKQEKQAKAQSFDSLKHCLFLFLEKLQETRNYYSHYKYSESTKEPMLEKELLKKMYNIFDDNIQLVIKDYQHNKDINPDEDFKHLDRTEEDFNYYFTRNKKGNITESGLLFFVSLFLEKKDAIWMQQKLRGFKDNRESKKKMTHEVFCRSRMLLPKLRLESTQTQDWILLDMLNELIRCPKSLYERLQGEDREKFKVPFDPADEDYDAEQEPFKNTLVRHQDRFPYFALRYFDYNEIFTNLRFQIDLGTFHFSIYKKLIGGQKEDRHLTHKLYGFERIQEFAKQNRPDEWKAIVKDLDTYETSNERYISETTPHYHLENQKIGIRFRNDNDEIWPSLKTNGENNEKSKYKLDKQYQAEAFLSVHELLPMMFYYLLLKKEEPNNDKKNASIVEGFIKREIRDMYKLYDAFANGEINNIDDLEKYCEDKGIPKRHLPKQMVAILYDEHKDMVKEAKRKQRKMVKDTEKLLAALEKQTQEKTEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRSYLTKKIEFLNKLKPEDWEKNQYFLKLKEPKTNRETLVQGWKNGFNLPRGIFTEPIREWFKRHQNDSKEYEKVEALDRVGLVTKVIPLFFKKEDSKDKEEDLKKDAQKEINNCVQPFYSFPYNVGNIHKPDEKDFLHREERIELWDKKKDKFKGYKAKVKSKKLTDKEKEEYRSYLEFQSWNKFERELRLVRNQDIVTWLLCTELIDKLKVEGLNVEELKKLRLKDIDTDTAKQEKNNILNRVMPMQLPVTVYEIDDSHNIVKDRPLHTVYIEETKTKLLKQGNFKALVKDRRLNGLFSFVDTSSEAELKSNPISKSLVEYELGEYQNARIETIKDMLLLEETLIEKYKNLPTDNFSDMLNGWLEGKDEADKARFQNDVKLLVAVRNAFSHNQYPMRNRIAFANINPFSLSSADTSEEKKLDIANQLKDKTHKIIKRIIEIEKPIETKE

SEQ ID NO: 91 - protein, 1127 aa, Prevotella buccae; identical to SEQ ID NO: 69

SEQ ID NO: 92 - protein, 1125 aa, Prevotella pallens
MKEEEKGKTPVVSTYNKDDKHFWAAFLNLARHNVYITVNHINKILGEGEINRDGYENTLEKSWNEIKDINKKDRLSKLIIKHFPFLEVTTYQRNSADTTKQKEEKQAEAQSLESLKKSFFVFIYKLRDLRNHYSHYKHSKSLERPKFEEDLQEKMYNIFDASIQLVKEDYKHNTDIKTEEDFKHLDRKGQFKYSFADNEGNITESGLLFFVSLFLEKKDAIWVQKKLEGFKCSNESYQKMTNEVFCRSRMLLPKLRLQSTQTQDWILLDMLNELIRCPKSLYERLREEDRKKFRVPIEIADEDYDAEQEPFKNALVRHQDRFPYFALRYFDYNEIFTNLRFQIDLGTYHFSIYKKQIGDYKESHHLTHKLYGFERIQEFTKQNRPDEWRKFVKTFNSFETSKEPYIPETTPHYHLENQKIGIRFRNDNDKIWPSLKTNSEKNEKSKYKLDKSFQAEAFLSVHELLPMMFYYLLLKTENTDNDNEIETKKKENKNDKQEKHKIEEIIENKITEIYALYDAFANGKINSIDKLEEYCKGKDIEIGHLPKQMIAILKSEHKDMATEAKRKQEEMLADVQKSLESLDNQINEEIENVERKNSSLKSGEIASWLVNDMMRFQPVQKDNEGNPLNNSKANSTEYQMLQRSLALYNKEEKPTRYFRQVNLIESSNPHPFLNNTEWEKCNNILSFYRSYLEAKKNFLESLKPEDWEKNQYFLMLKEPKTNCETLVQGWKNGFNLPRGIFTEPIRKWFMEHRKNITVAELKRVGLVAKVIPLFFSEEYKDSVQPFYNYLFNVGNINKPDEKNFLNCEERRELLRKKKDEFKKMTDKEKEENPSYLEFQSWNKFERELRLVRNQDIVTWLLCMELFNKKKIKELNVEKIYLKNINTNTTKKEKNTEEKNGEEKIIKEKNNILNRIMPMRLPIKVYGRENFSKNKKKKIRRNTFFTVYIEEKGTKLLKQGNFKALERDRRLGGLFSFVKTHSKAESKSNTISKSRVEYELGEYQKARIEIIKDMLALEETLIDKYNSLDTDNFHNMLTGWLKLKDEPDKASFQNDVDLLIAVRNAFSHNQYPMRNRIAFANINPFSLSSANTSEEKGLGIANQLKDKTHKTIEKIIEIEKPIETKE

SEQ ID NO: 93 - protein, 1157 aa, Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSEIVIENKVLDFLNSSLVSTALHVKDKYLKTDKTKEFLKETIAAELDILIEAYKKKQIEKKNTRFKANKREDILNAIYNEAFWSFINDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKANYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMTEEFKSKWKGYQHTELQKLFAYYDTSKSDLDLILSDMVMVKDYPIELIALVKKSRTLVDFLNKYLEARLGYMENVITRVKNSIGTPQFKTVRKECFTFLKKSNYTVVSLDKQVERILSMPLFIERGFMDDKPTMLEGKSYQQHKEKFADWFVHYKENSNYQNFYDTEVYEITTEDKREKAKVTKKIKQQQKNDVFTLMMVNYMLEEVLKLSSNDRLSLNELYQTKEERIVNKQVAKDTQERNKNYIWNKVVDLQLCEGLVRIDKVKLKDIGNFRKYENDSRVKEFLTYQSDIVWSAYLSNEVDSNKLYVIERQLDNYESIRSKELLKEVQEIECSVYNQVANKESLKQSGNENFKQYVLQGLVPIGMDVREMLILSTDVKFIKEEIIQLGQAGEVEQDLYSLIYIRNKFAHNQLPIKEFFDFCENNYRSISDNEYYAEYYMEIFRSIKEKYTS

SEQ ID NO: 94 - protein, 1157 aa, Myroides odoratimimus
MKDILTTDTTEKQNRFYSHKIADKYFFGGYFNLASNNIYEVFEEVNKRNTFGKLAKRDNGNLKNYIIHVFKDELSISDFEKRVAIFASYFPILETVDKKSIKERNRTIDLTLSQRIRQFREMLISLVTAVDQLRNFYTHYHHSEIVIENKVLDFLNSSLVSTALHVKDKYLKTDKTKEFLKETIAAELDILIEAYKKKQIEKKNTRFKANKREDILNAIYNEAFWSFINDKDKDKETVVAKGADAYFEKNHHKSNDPDFALNISEKGIVYLLSFFLTNKEMDSLKANLTGFKGKVDRESGNSIKYMATQRIYSFHTYRGLKQKIRTSEEGVKETLLMQMIDELSKVPNVVYQHLSTTQQNSFIEDWNEYYKDYEDDVETDDLSRVIHPVIRKRYEDRFNYFAIRFLDEFFDFPTLRFQVHLGDYVHDRRTKQLGKVESDRIIKEKVTVFARLKDINSAKASYFHSLEEQDKEELDNKWTLFPNPSYDFPKEHTLQHQGEQKNAGKIGIYVKLRDTQYKEKAALEEARKSLNPKERSATKASKYDIITQIIEANDNVKSEKPLVFTGQPIAYLSMNDIHSMLFSLLTDNAELKKTPEEVEAKLIDQIGKQINEILSKDTDTKILKKYKDNDLKETDTDKITRDLARDKEEIEKLILEQKQRADDYNYTSSTKFNIDKSRKRKHLLFNAEKGKIGVWLANDIKRFMFKESKSKWKGYQHTELQKLFAYFDTSKSDLELILSDMVMVKDYPIELIDLVRKSRTLVDFLNKYLEARLGYIENVITRVKNSIGTPQFKTVRKECFAFLKESNYTVASLDKQIERILSMPLFIERGFMDSKPTMLEGKSYQQHKEDFADWFVHYKENSNYQNFYDTEVYEIITEDKREQAKVTKKIKQQQKNDVFTLMMVNYMLEEVLKLPSNDRLSLNELYQTKEERIVNKQVAKDTQERNKNYIWNKVVDLQLCEGLVRIDKVKLKDIGNFRKYENDSRVKEFLTYQSDIVWSGYLSNEVDSNKLYVIERQLDNYESIRSKELLKEVQEIECIVYNQVANKESLKQSGNENFKQYVLQGLLPRGTDVREMLILSTDVKFKKEEIMQLGQVREVEQDLYSLIYIRNKFAHNQLPIKEFFDFCENNYRPISDNEYYAEYYMEIFRSIKEKYAS

SEQ ID NO: 95 - protein, 1224 aa, Bergeyella zoohelcum; identical to SEQ ID NO: 67

SEQ ID NO: 96 - protein, 1150 aa, Prevotella saccharolytica
MMEKENVQGSHIYYEPTDKCFWAAFYNLARHNAYLTIAHINSFVNSKKGINNDDKVLDIIDDWSKFDNDLLMGARLNKLILKHFPFLKAPLYQLAKRKTRKQQGKEQQDYEKKGDEDPEVIQEAIANAFKMANVRKTLHAFLKQLEDLRNHFSHYNYNSPAKKMEVKFDDGFCNKLYYVFDAALQMVKDDNRMNPEINMQTDFEHLVRLGRNRKIPNTFKYNFTNSDGTINNNGLLFFVSLFLEKRDAIWMQKKIKGFKGGTENYMRMTNEVFCRNRMVIPKLRLETDYDNHQLMFDMLNELVRCPLSLYKRLKQEDQDKFRVPIEFLDEDNEADNPYQENANSDENPTEETDPLKNTLVRHQHRFPYFVLRYFDLNEVFKQLRFQINLGCYHFSIYDKTIGERTEKRHLTRTLFGFDRLQNFSVKLQPEHWKNMVKHLDTEESSDKPYLSDAMPHYQIENEKIGIHFLKTDTEKKETVWPSLEVEEVSSNRNKYKSEKNLTADAFLSTHELLPMMFYYQLLSSEEKTRAAAGDKVQGVLQSYRKKIFDIYDDFANGTINSMQKLDERLAKDNLLRGNMPQQMLAILEHQEPDMEQKAKEKLDRLITETKKRIGKLEDQFKQKVRIGKRRADLPKVGSIADWLVNDMMRFQPAKRNADNTGVPDSKANSTEYRLLQEALAFYSAYKDRLEPYFRQVNLIGGTNPHPFLHRVDWKKCNHLLSFYHDYLEAKEQYLSHLSPADWQKHQHFLLLKVRKDIQNEKKDWKKSLVAGWKNGFNLPRGLFTESIKTWFSTDADKVQITDTKLFENRVGLIAKLIPLYYDKVYNDKPQPFYQYPFNINDRYKPEDTRKRFTAASSKLWNEKKMLYKNAQPDSSDKIEYPQYLDFLSWKKLERELRMLRNQDMMVWLMCKDLFAQCTVEGVEFADLKLSQLEVDVNVQDNLNVLNNVSSMILPLSVYPSDAQGNVLRNSKPLHTVYVQENNTKLLKQGNFKSLLKDRRLNGLFSFIAAEGEDLQQHPLTKNRLEYELSIYQTMRISVFEQTLQLEKAILTRNKTLCGNNFNNLLNSWSEHRTDKKTLQPDIDFLIAVRNAFSHNQYPMSTNTVMQGIEKFNIQTPKLEEKDGLGIASQLAKKTKDAASRLQNIINGGTN

SEQ ID NO: 97 - protein, 1175 aa, Porphyromonas gingivalis
MTEQNEKPYNGTYYTLEDKHFWAAFFNLARHNAYITLTHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRCGNNDNPFFKHHFVDREEKVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAERVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDRVQPFYDYPFNVGNSLKPKKGRFLSKEKRAEEWESGKERFRDLEAWSHSAARRIEDAFAGIENASRENKKKIEQLLQDLSLWETFESKLKVKADKINIAKLKKEILEAKEHPYLDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDETLFSSIRKYDPSSPDAIEERMGLNIAHRLSEEVKQAKEMVERIIQA

SEQ ID NO: 98 - protein, 1115 aa, Bacteroides pyogenes
MESIKNSQKSTGKTLQKDPPYFGLYLNMALLNVRKVENHIRKWLGDVALLPEKSGFHSLLTTDNLSSAKWTRFYYKSRKFLPFLEMFDSDKKSYENRRETTECLDTIDRQKISSLLKEVYGKLQDIRNAFSHYHIDDQSVKHTALIISSEMHRFIENAYSFALQKTRARFTGVFVETDFLQAEEKGDNKKFFAIGGNEGIKLKDNALIFLICLFLDREEAFKFLSRATGFKSTKEKGFLAVRETFCALCCRQPHERLLSVNPREALLMDMLNELNRCPDILFEMLDEKDQKSFLPLLGEEEQAHILENSLNDELCEAIDDPFEMIASLSKRVRYKNRFPYLMLRYIEEKNLLPFIRFRIDLGCLELASYPKKMGEENNYERSVTDHAMAFGRLTDFHNEDAVLQQITKGITDEVRFSLYAPRYAIYNNKIGFVRTGGSDKISFPTLKKKGGEGHCVAYTLQNTKSFGFISIYDLRKILLLSFLDKDKAKNIVSGLLEQCEKHWKDLSENLFDAIRTELQKEFPVPLIRYTLPRSKGGKLVSSKLADKQEKYESEFERRKEKLTEILSEKDFDLSQIPRRMIDEWLNVLPTSREKKLKGYVETLKLDCRERLRVFEKREKGEHPVPPRIGEMATDLAKDIIRMVIDQGVKQRITSAYYSEIQRCLAQYAGDDNRRHLDSIIRELRLKDTKNGHPFLGKVLRPGLGHTEKLYQRYFEEKKEWLEATFYPAASPKRVPRFVNPPTGKQKELPLIIRNLMKERPEWRDWKQRKNSHPIDLPSQLFENEICRLLKDKIGKEPSGKLKWNEMFKLYWDKEFPNGMQRFYRCKRRVEVFDKVVEYEYSEEGGNYKKYYEALIDEVVRQKISSSKEKSKLQVEDLTLSVRRVFKRAINEKEYQLRLLCEDDRLLFMAVRDLYDWKEAQLDLDKIDNMLGEPVSVSQVIQLEGGQPDAVIKAECKLKDVSKLMRYCYDGRVKGLMPYFANHEATQEQVEMELRHYEDHRRRVFNWVFALEKSVLKNEKLRRFYEESQGGCEHRRCIDALRKASLVSEEEYEFLVHIRNKSAHNQFPDLEIGKLPPNVTSGFCECIWSKYKAIICRIIPFIDPERRFFGKLLEQK

SEQ ID NO: 99 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLQKFRKDGDGKARAIPLVGEMATFLSQDIVRMIISEETKKLITSAYYNEMQRSLAQYAGEENRHQFRAIVAELRLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 100 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSGFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 101 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMDQRQLPSRLLDEWMNIRPASHSVKLRTYVKQLNEDCRLRLQKFRKDGDGKARAIPLVGEMATFLSQDIVRMIISEETKKLITSAYYNEMQRSLAQYAGEENRHQFRAIVAELRLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKVMELLKVKDGKKKWNEAFKDWWSTKYPDGMQPFYGLRRELNIHGKSVSYIPSDGKKFADCYTHLMEKTVRDKKRELRTAGKPVPPDLAAYIKRSFHRAVNEREFMLRLVQEDDRLMLMAINKIMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEIPLIYRDVSAKVGSIEGSSAKDLPEGSSLVDSLWKKYEMIIRKILPILDPENRFFGKLLNNMSQPINDL

SEQ ID NO: 102 - protein, 1125 aa, Prevotella intermedia
MKMEDDKKTTESTNMLDNKHFWAAFLNLARHNVYITVNHINKVLELKNKKDQDIIIDNDQDILAIKTHWEKVNGDLNKTERLRELMTKHFPFLETAIYTKNKEDKEEVKQEKQAEAQSLESLKDCLFLFLEKLQEARNYYSHYKYSESTKEPMLEEGLLEKMYNIFDDNIQLVIKDYQHNKDINPDEDFKHLDRKGQFKYSFADNEGNITESGLLFFVSLFLEKKDAIWMQQKLTGFKDNRESKKKMTHEVFCRRRMLLPKLRLESTQTQDWILLDMLNELIRCPKSLYERLQGEYRKKFNVPFDSADEDYDAEQEPFKNTLVRHQDRFPYFALRYFDYNEIFTNLRFQIDLGTYHFSIYKKLIGGQKEDRHLTHKLYGFERIQEFAKQNRPDEWKALVKDLDTYETSNERYISETTPHYHLENQKIGIRFRNGNKEIWPSLKTNGENNEKSKYKLDKPYQAEAFLSVHELLPMMFYYLLLKKEEPNNDKKNASIVEGFIKREIRDMYKLYDAFANGEINNIGDLEKYCEDKGIPKRHLPKQMVAILYDEPKDMVKEAKRKQKEMVKDTKKLLATLEKQTQEEIEDGGRNIRLLKSGEIARWLVNDMMRFQPVQKDNEGNPLNNSKANSTEYQMLQRSLALYNKEEKPTRYFRQVNLINSSNPHPFLKWTKWEECNNILSFYRNYLTKKIEFLNKLKPEDWEKNQYFLKLKEPKTNRETLVQGWKNGFNLPRGIFTEPIREWFKRHQNDSKEYEKVEALKRVGLVTKVIPLFFKEEYFKEDAQKEINNCVQPFYSFPYNVGNIHKPDEKDFLPSEERKKLWGDKKDKFKGYKAKVKSKKLTDKEKEEYRSYLEFQSWNKFERELRLVRNQDIVTWLLCTELIDKMKVEGLNVEELQKLRLKDIDTDTAKQEKNNILNRIMPMQLPVTVYEIDDSHNIVKDRPLHTVYIEETKTKLLKQGNFKALVKDRRLNGLFSFVDTSSKAELKDKPISKSVVEYELGEYQNARIETIKDMLLLEKTLIKKYEKLPTDNFSDMLNGWLEGKDESDKARFQNDVKLLVAVRNAFSHNQYPMRNRIAFANINPFSLSSADISEEKKLDIANQLKDKTHKIIKKIIEIEKPIETKE

SEQ ID NO: 103 - protein, 1161 aa, Bacteroidetes bacterium
MENQTQKGKGIYYYYTKNEDKHYFGSFLNLANNNIEQIIEEFRIRLSLKDEKNIKEIINNYFTDKKSYTDWERGINILKEYLPVIDYLDLAITDKEFEKIDLKQKETAKRKYFRTNFSLLIDTIIDLRNFYTHYFHKPISINPDVAKFLDKNLLNVCLDIKKQKMKTDKTKQALKDGLDKELKKLIELKKAELKEKKIKTWNITENVEGAVYNDAFNHMVYKNNAGVTILKDYHKSILPDDKIDSELKLNFSISGLVFLLSMFLSKKEIEQFKSNLEGFKGKVIGENGEYEISKFNNSLKYMATHWIFSYLTFKGLKQRVKNTFDKETLLMQMIDELNKVPHEVYQTLSKEQQNEFLEDINEYVQDNEENKKSMENSIVVHPVIRKRYDDKFNYFAIRFLDEFANFPTLKFFVTAGNFVHDKREKQIQGSMLTSDRMIKEKINVFGKLTEIAKYKSDYFSNENTLETSEWELFPNPSYLLIQNNIPVHIDLIHNTEEAKQCQIAIDRIKCTTNPAKKRNTRKSKEEIIKIIYQKNKNIKYGDPTALLSSNELPALIYELLVNKKSGKELENIIVEKIVNQYKTIAGFEKGQNLSNSLITKKLKKSEPNEDKINAEKIILAINRELEITENKLNIIKNNRAEFRTGAKRKHIFYSKELGQEATWIAYDLKRFMPEASRKEWKGFHHSELQKFLAFYDRNKNDAKALLNMFWNFDNDQLIGNDLNSAFREFHFDKFYEKYLIKRDEILEGFKSFISNFKDEPKLLKKGIKDIYRVFDKRYYIIKSTNAQKEQLLSKPICLPRGIFDNKPTYIEGVKVESNSALFADWYQYTYSDKHEFQSFYDMPRDYKEQFEKFELNNIKSIQNKKNLNKSDKFIYFRYKQDLKIKQIKSQDLFIKLMVDELFNVVFKNNIELNLKKLYQTSDERFKNQLIADVQKNREKGDTSDNKMNENFIWNMTIPLSLCNGQIEEPKVKLKDIGKFRKLETDDKVIQLLEYDKSKVWKKLEIEDELENMPNSYERIRREKLLKGIQEFEHFLLEKEKFDGINHPKHFEQDLNPNFKTYVINGVLRKNSKLNYTEIDKLLDLEHISIKDIETSAKEIHLAYFLIHVRNKFGHNQLPKLEAFELMKKYYKKNNEETYAEYFHKVSSQIVNEFKNSLEKHS

SEQ ID NO: 104 - protein, 1165 aa, Chryseobacterium jejuense
MEKTQTGLGIYYDHTKLQDKYFFGGFFNLAQNNIDNVIKAFIIKFFPERKDKDINIAQFLDICFKDNDADSDFQKKNKFLRIHFPVIGFLTSDNDKAGFKKKFALLLKTISELRNFYTHYYHKSIEFPSELFELLDDIFVKTTSEIKKLKKKDDKTQQLLNKNLSEEYDIRYQQQIERLKELKAQGKRVSLTDETAIRNGVFNAAFNHLIYRDGENVKPSRLYQSSYSEPDPAENGISLSQNSILFLLSMFLERKETEDLKSRVKGFKAKIIKQGEEQISGLKFMATHWVFSYLCFKGIKQKLSTEFHEETLLIQIIDELSKVPDEVYSAFDSKTKEKFLEDINEYMKEGNADLSLEDSKVIHPVIRKRYENKFNYFAIRFLDEYLSSTSLKFQVHVGNYVHDRRVKHINGTGFQTERIVKDRIKVFGRLSNISNLKADYIKEQLELPNDSNGWEIFPNPSYIFIDNNVPIHVLADEATKKGIELFKDKRRKEQPEELQKRKGKISKYNIVSMIYKEAKGKDKLRIDEPLALLSLNEIPALLYQILEKGATPKDIELIIKNKLTERFEKIKNYDPETPAPASQISKRLRNNTTAKGQEALNAEKLSLLIEREIENTETKLSSIEEKRLKAKKEQRRNTPQRSIFSNSDLGRIAAWLADDIKRFMPAEQRKNWKGYQHSQLQQSLAYFEKRPQEAFLLLKEGWDTSDGSSYWNNWVMNSFLENNHFEKFYKNYLMKRVKYFSELAGNIKQHTHNTKFLRKFIKQQMPADLFPKRHYILKDLETEKNKVLSKPLVFSRGLFDNNPTFIKGVKVTENPELFAEWYSYGYKTEHVFQHFYGWERDYNELLDSELQKGNSFAKNSIYYNRESQLDLIKLKQDLKIKKIKIQDLFLKRIAEKLFENVFNYPTTLSLDEFYLTQEERAEKERIALAQSLREEGDNSPNIIKDDFIWSKTIAFRSKQIYEPAIKLKDIGKFNRFVLDDEESKASKLLSYDKNKIWNKEQLERELSIGENSYEVIRREKLFKEIQNLELQILSNWSWDGINHPREFEMEDQKNTRHPNFKMYLVNGILRKNINLYKEDEDFWLESLKENDFKTLPSEVLETKSEMVQLLFLVILIRNQFAHNQLPEIQFYNFIRKNYPEIQNNTVAELYLNLIKLAVQKLKDNS

SEQ ID NO: 105 - protein, 1156 aa, Chryseobacterium carnipullorum
MNTRVTGMGVSYDHTKKEDKHFFGGFLNLAQDNITAVIKAFCIKFDKNPMSSVQFAESCFTDKDSDTDFQNKVRYVRTHLPVIGYLNYGGDRNTFRQKLSTLLKAVDSLRNFYTHYYHSPLALSTELFELLDTVFASVAVEVKQHKMKDDKTRQLLSKSLAEELDIRYKQQLERLKELKEQGKNIDLRDEAGIRNGVLNAAFNHLIYKEGEIAKPTLSYSSFYYGADSAENGITISQSGLLFLLSMFLGKKEIEDLKSRIRGFKAKIVRDGEENISGLKFMATHWIFSYLSFKGMKQRLSTDFHEETLLIQIIDELSKVPDEVYHDFDTATREKFVEDINEYIREGNEDFSLGDSTIIHPVIRKRYENKFNYFAVRFLDEFIKFPSLRFQVHLGNFVHDRRIKDIHGTGFQTERVVKDRIKVFGKLSEISSLKTEYIEKELDLDSDTGWEIFPNPSYVFIDNNIPIYISTNKTFKNGSSEFIKLRRKEKPEEMKMRGEDKKEKRDIASMIGNAGSLNSKTPLAMLSLNEMPALLYEILVKKTTPEEIELIIKEKLDSHFENIKNYDPEKPLPASQISKRLRNNTTDKGKKVINPEKLIHLINKEIDATEAKFALLAKNRKELKEKFRGKPLRQTIFSNMELGREATWLADDIKRFMPDILRKNWKGYQHNQLQQSLAFFNSRPKEAFTILQDGWDFADGSSFWNGWIINSFVKNRSFEYFYEAYFEGRKEYFSSLAENIKQHTSNHRNLRRFIDQQMPKGLFENRHYLLENLETEKNKILSKPLVFPRGLFDTKPTFIKGIKVDEQPELFAEWYQYGYSTEHVFQNFYGWERDYNDLLESELEKDNDFSKNSIHYSRTSQLELIKLKQDLKIKKIKIQDLFLKLIAGHIFENIFKYPASFSLDELYLTQEERLNKEQEALIQSQRKEGDHSDNIIKDNFIGSKTVTYESKQISEPNVKLKDIGKFNRFLLDDKVKTLLSYNEDKVWNKNDLDLELSIGENSYEVIRREKLFKKIQNFELQTLTDWPWNGTDHPEEFGTTDNKGVNHPNFKMYVVNGILRKHTDWFKEGEDNWLENLNETHFKNLSFQELETKSKSIQTAFLIIMIRNQFAHNQLPAVQFFEFIQKKYPEIQGSTTSELYLNFINLAVVELLELLEK

SEQ ID NO: 106 - protein, 1036 aa, Chryseobacterium ureilyticum
METQILGNGISYDHTKTEDKHFFGGFLNTAQNNIDLLIKAYISKFESSPRKLNSVQFPDVCFKKNDSDADFQHKLQFIRKHLPVIQYLKYGGNREVLKEKFRLLLQAVDSLRNFYTHFYHKPIQLPNELLTLLDTIFGEIGNEVRQNKMKDDKTRHLLKKNLSEELDFRYQEQLERLRKLKSEGKKVDLRDTEAIRNGVLNAAFNHLIFKDAEDFKPTVSYSSYYYDSDTAENGISISQSGLLFLLSMFLGRREMEDLKSRVRGFKARIIKHEEQHVSGLKFMATHWVFSEFCFKGIKTRLNADYHEETLLIQLIDELSKVPDELYRSFDVATRERFIEDINEYIRDGKEDKSLIESKIVHPVIRKRYESKFNYFAIRFLDEFVNFPTLRFQVHAGNYVHDRRIKSIEGTGFKTERLVKDRIKVFGKLSTISSLKAEYLAKAVNITDDTGWELLPHPSYVFIDNNIPIHLTVDPSFKNGVKEYQEKRKLQKPEEMKNRQGGDKMHKPAISSKIGKSKDINPESPVALLSMNEIPALLYEILVKKASPEEVEAKIRQKLTAVFERIRDYDPKVPLPASQVSKRLRNNTDTLSYNKEKLVELANKEVEQTERKLALITKNRRECREKVKGKFKRQKVFKNAELGTEATWLANDIKRFMPEEQKKNWKGYQHSQLQQSLAFFESRPGEARSLLQAGWDFSDGSSFWNGWVMNSFARDNTFDGFYESYLNGRMKYFLRLADNIAQQSSTNKLISNFIKQQMPKGLFDRRLYMLEDLATEKNKILSKPLIFPRGIFDDKPTFKKGVQVSEEPEAFADWYSYGYDVKHKFQEFYAWDRDYEELLREELEKDTAFTKNSIHYSRESQIELLAKKQDLKVKKVRIQDLYLKLMAEFLFENVFGHELALPLDQFYLTQEERLKQEQEAIVQSQRPKGDDSPNIVKENFIWSKTIPFKSGRVFEPNVKLKDIGKFRNLLTDEKVDILLSYNNTEIGKQVIENELIIGAGSYEFIRREQLFKEIQQMKRLSLRSVRGMGVPIRLNLK

SEQ ID NO: 107 - protein, 1127 aa, Prevotella buccae
MQKQDKLFVDRKKNAIFAFPKYITIMENQEKPEPIYYELTDKHFWAAFLNLARHNVYTTINHINRRLEIAELKDDGYMMDIKGSWNEQAKKLDKKVRLRDLIMKHFPFLEAAAYEITNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYDAEEEPFKNTLVRHQDRFPYFVLRYFDLNEIFEQLRFQIDLGTYHFSIYNKRIGDEDEVRHLTHHLYGFARIQDFAQQNQPEVWRKLVKDLDYFEASQEPYIPKTAPHYHLENEKIGIKFCSTHNNLFPSLKTEKTCNGRSKFNLGTQFTAEAFLSVHELLPMMFYYLLLTKDYSRKESADKVEGIIRKEISNIYAIYDAFANGEINSIADLTCRLQKTNILQGHLPKQMISILEGRQKDMEKEAERKIGEMIDDTQRRLDLLCKQTNQKIRIGKRNAGLLKSGKIADWLVNDMMRFQPVQKDQNNIPINNSKANSTEYRMLQRALALFGSENFRLKAYFNQMNLVGNDNPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNKLKPQKGQFLDKKERVELWQKNKELFKNYPSEKKKTDLAYLDFLSWKKFERELRLIKNQDIVTWLMFKELFNMATVEGLKIGEIHLRDIDTNTANEESNNILNRIMPMKLPVKTYETDNKGNILKERPLATFYIEETETKVLKQGNFKVLAKDRRLNGLLSFAETTDIDLEKNPITKLSVDHELIKYQTTRISIFEMTLGLEKKLINKYPTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 108 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHNLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 109 - protein, 1175 aa, Porphyromonas gingivalis
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREEKVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRDLEAWSHSAARRIEDAFVGIEYASWENKKKIEQLLQDLSLWETFESKLKVKADKINIAKLKKEILEAKEHPYHDFKSWQKFERELRLVKNQDIITWMMCRDLMEENKVEGLDTGTLYLKDIRTDVQEQGSLNVLNHVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDESFREMLESWSDPLLDKWPDLQREVRLLIAVRNAFSHNQYPMYDETIFSSIRKYDPSSLDAIEERMGLNIAHRLSEEVKLAKEMVERIIQA

SEQ ID NO: 110 - protein, 1125 aa, Prevotella pallens; identical to SEQ ID NO: 92

SEQ ID NO: 111 - protein, 1157 aa, Myroides odoratimimus; identical to SEQ ID NO: 93

SEQ ID NO: 112 - protein, 1157 aa, Myroides odoratimimus; identical to SEQ ID NO: 94

SEQ ID NO: 113 - protein, 1127 aa, Prevotella species
MQKQDKLFVDRKKNAIFAFPKYITIMENQEKPEPIYYELTDKHFWAAFLNLARHNVYTTINHINRRLEIAELKDDGYMMGIKGSWNEQAKKLDKKVRLRDLIMKHFPFLEAAAYEITNSKSPNNKEQREKEQSEALSLNNLKNVLFIFLEKLQVLRNYYSHYKYSEESPKPIFETSLLKNMYKVFDANVRLVKRDYMHHENIDMQRDFTHLNRKKQVGRTKNIIDSPNFHYHFADKEGNMTIAGLLFFVSLFLDKKDAIWMQKKLKGFKDGRNLREQMTNEVFCRSRISLPKLKLENVQTKDWMQLDMLNELVRCPKSLYERLREKDRESFKVPFDIFSDDYDAEEEPFKNTLVRHQDRFPYFVLRYFDLNEIFEQLRFQIDLGTYHFSIYNKRIGDEDEVRHLTHHLYGFARIQDFAPQNQPEEWRKLVKDLDHFETSQEPYISKTAPHYHLENEKIGIKFCSTHNNLFPSLKREKTCNGRSKFNLGTQFTAEAFLSVHELLPMMFYYLLLTKDYSRKESADKVEGIIRKEISNIYAIYDAFANNEINSIADLTCRLQKTNILQGHLPKQMISILEGRQKDMEKEAERKIGEMIDDTQRRLDLLCKQTNQKIRIGKRNAGLLKSGKIADWLVSDMMRFQPVQKDTNNAPINNSKANSTEYRMLQHALALFGSESSRLKAYFRQMNLVGNANPHPFLAETQWEHQTNILSFYRNYLEARKKYLKGLKPQNWKQYQHFLILKVQKTNRNTLVTGWKNSFNLPRGIFTQPIREWFEKHNNSKRIYDQILSFDRVGFVAKAIPLYFAEEYKDNVQPFYDYPFNIGNKLKPQKGQFLDKKERVELWQKNKELFKNYPSEKNKTDLAYLDFLSWKKFERELRLIKNQDIVTWLMFKELFKTTTVEGLKIGEIHLRDIDTNTANEESNNILNRIMPMKLPVKTYETDNKGNILKERPLATFYIEETETKVLKQGNFKVLAKDRRLNGLLSFAETTDIDLEKNPITKLSVDYELIKYQTTRISIFEMTLGLEKKLIDKYSTLPTDSFRNMLERWLQCKANRPELKNYVNSLIAVRNAFSHNQYPMYDATLFAEVKKFTLFPSVDTKKIELNIAPQLLEIVGKAIKEIEKSENKN

SEQ ID NO: 114 - protein, 1119 aa, Porphyromonas gingivalis
MTEQNERPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREEKVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSDEASAERVQGRIKRVIEDVYAVYDAFARGEINTRDELDACLADKGIRRGHLPRQMIGILSQEHKDMEEKVRKKLQEMIVDTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMICRDLMEENKVEGLDTGTLYLKDIRTDVQEQGNLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHGNVRLLIAVRNAFSHNQYPMYDEAVFSSIRKYDPSSPDAIEERMGLNIAHRLSEEVKQAKEMAERIIQA

SEQ ID NO: 115 - protein, 1154 aa, Paludibacter propionicigenes
MKTSANNIYFNGINSFKKIFDSKGAIAPIAEKSCRNFDIKAQNDVNKEQRIHYFAVGHTFKQLDTENLFEYVLDENLRAKRPTRFISLQQFDKEFIENIKRLISDIRNINSHYIHRFDPLKIDAVPTNIIDFLKESFELAVIQIYLKEKGINYLQFSENPHADQKLVAFLHDKFLPLDEKKTSMLQNETPQLKEYKEYRKYFKTLSKQAAIDQLLFAEKETDYIWNLFDSHPVLTISAGKYLSFYSCLFLLSMFLYKSEANQLISKIKGFKKNTTEEEKSKREIFTFFSKRFNSMDIDSEENQLVKFRDLILYLNHYPVAWNKDLELDSSNPAMTDKLKSKIIELEINRSFPLYEGNERFATFAKYQIWGKKHLGKSIEKEYINASFTDEEITAYTYETDTCPELKDAHKKLADLKAAKGLFGKRKEKNESDIKKTETSIRELQHEPNPIKDKLIQRIEKNLLTVSYGRNQDRFMDFSARFLAEINYFGQDASFKMYHFYATDEQNSELEKYELPKDKKKYDSLKFHQGKLVHFISYKEHLKRYESWDDAFVIENNAIQLKLSFDGVENTVTIQRALLIYLLEDALRNIQNNTAENAGKQLLQEYYSHNKADLSAFKQILTQQDSIEPQQKTEFKKLLPRRLLNNYSPAINHLQTPHSSLPLILEKALLAEKRYCSLVVKAKAEGNYDDFIKRNKGKQFKLQFIRKAWNLMYFRNSYLQNVQAAGHHKSFHIERDEFNDFSRYMFAFEELSQYKYYLNEMFEKKGFFENNEFKILFQSGTSLENLYEKTKQKFEIWLASNTAKTNKPDNYHLNNYEQQFSNQLFFINLSHFINYLKSTGKLQTDANGQIIYEALNNVQYLIPEYYYTDKPERSESKSGNKLYNKLKATKLEDALLYEMAMCYLKADKQIADKAKHPITKLLTSDVEFNITNKEGIQLYHLLVPFKKIDAFIGLKMHKEQQDKKHPTSFLANIVNYLELVKNDKDIRKTYEAFSTNPVKRTLTYDDLAKIDGHLISKSIKFTNVTLELERYFIFKESLIVKKGNNIDFKYIKGLRNYYNNEKKKNEGIRNKAFHFGIPDSKSYDQLIRDAEVMFIANEVKPTHATKYTDLNKQLHTVCDKLMETVHNDYFSKEGDGKKKREAAGQKYFENIISAK

SEQ ID NO: 116 - protein, 1119 aa, Porphyromonas gingivalis
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKNKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREGTVTEAGLLFFVSLFLEKRDAIWMQKKIRGFKGGTETYQQMTNEVFCRSRISLPKLKLESLRTDDWMLLDMLNELVRCPKSLYDRLREEDRARFRVPVDILSDEEDTDGAEEDPFKNTLVRHQDRFPYFALRYFDLKKVFTSLRFQIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRFTAEAFLSAHELMPMMFYYFLLREKYSEEASAERVQGRIKRVIEDVYAVYDAFARDEINTRDELDACLADKGIRRGHLPRQMIGILSQEHKDMEEKIRKKLQEMMADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDWVQPFYNYPFNVGNSLKPKKGRFLSKEKRAEEWESGKERFRLAKLKKEILEAKEHPYLDFKSWQKFERELRLVKNQDIITWMICGDLMEENKVEGLDTGTLYLKDIRTDVQEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRCPHLPDKNFRKMLESWSDPLLDKWPDLHRKVRLLIAVRNAFSHNQYPMYDEAVFSSIRKYDPSFPDAIEERMGLNIAHRLSEEVKQAKETVERIIQA

SEQ ID NO: 117 - protein, 1179 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKIYDFLDDTLLDVLITIKKKKVKNDTSRELLKEKLRPELTQLKNQKREELIKKGKKLLEENLENAVFNHCLRPFLEENKTDDKQNKTVSLRKYRKSKPNEETSITLTQSGLVFLMSFFLHRKEFQVFTSGLEGFKAKVNTIKEEEISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLSLVTEYKKNVYLKETSNIDLSRFPLFPNPSYVMANNNIPFYIDSRSNNLDEYLNQKKKAQSQNKKRNLTFEKYNKEQSKDAIIAMLQKEIGVKDLQQRSTIGLLSCNELPSMLYEVIVKDIKGAELENKIAQKIREQYQSIRDFTLDSPQKDNIPTTLIKTINTDSSVTFENQPIDIPRLKNAIQKELTLTQEKLLNVKEHEIEVDNYNRNKNTYKFKNQPKNKVDDKKLQRKYVFYRNEIRQEANWLASDLIHFMKNKSLWKGYMHNELQSFLAFFEDKKNDCIALLETVFNLKEDCILTKGLKNLFLKHGNFIDFYKEYLKLKEDFLNTESTFLENGLIGLPPKILKKELSKRFKYIFIVFQKRQFIIKELEEKKNNLYADAINLSRGIFDEKPTMIPFKKPNPDEFASWFVASYQYNNYQSFYELTPDIVERDKKKKYKNLRAINKVKIQDYYLKLMVDTLYQDLFNQPLDKSLSDFYVSKAEREKIKADAKAYQKRNDSSLWNKVIHLSLQNNRITANPKLKDIGKYKRALQDEKIATLLTYDDRTWTYALQKPEKENENDYKELHYTALNMELQEYEKVRSKELLKQVQELEKQILEEYTDFLSTQIHPADFEREGNPNFKKYLAHSILENEDDLDKLPEKVEAMRELDETITNPIIKKAIVLIIIRNKMAHNQYPPKFIYDLANRFVPKKEEEYFATYFNRVFETITKELWENKEKKDKTQV

SEQ ID NO: 118 - protein, 1145 aa, Psychroflexus torquis
MESIIGLGLSFNPYKTADKHYFGSFLNLVENNLNAVFAEFKERISYKAKDENISSLIEKHFIDNMSIVDYEKKISILNGYLPIIDFLDDELENNLNTRVKNFKKNFIILAEAIEKLRDYYTHFYHDPITFEDNKEPLLELLDEVLLKTILDVKKKYLKTDKTKEILKDSLREEMDLLVIRKTDELREKKKTNPKIQHTDSSQIKNSIFNDAFQGLLYEDKGNNKKTQVSHRAKTRLNPKDIHKQEERDFEIPLSTSGLVFLMSLFLSKKEIEDFKSNIKGFKGKVVKDENHNSLKYMATHRVYSILAFKGLKYRIKTDTFSKETLMMQMIDELSKVPDCVYQNLSETKQKDFIEDWNEYFKDNEENTENLENSRVVHPVIRKRYEDKFNYFAIRFLDEFANFKTLKFQVFMGYYIHDQRTKTIGTTNITTERTVKEKINVFGKLSKMDNLKKHFFSQLSDDENTDWEFFPNPSYNFLTQADNSPANNIPIYLELKNQQIIKEKDAIKAEVNQTQNRNPNKPSKRDLLNKILKTYEDFHQGDPTAILSLNEIPALLHLFLVKPNNKTGQQIENIIRIKIEKQFKAINHPSKNNKGIPKSLFADTNVRVNAIKLKKDLEAELDMLNKKHIAFKENQKASSNYDKLLKEHQFTPKNKRPELRKYVFYKSEKGEEATWLANDIKRFMPKDFKTKWKGCQHSELQRKLAFYDRHTKQDIKELLSGCEFDHSLLDINAYFQKDNFEDFFSKYLENRIETLEGVLKKLHDFKNEPTPLKGVFKNCFKFLKRQNYVTESPEIIKKRILAKPTFLPRGVFDERPTMKKGKNPLKDKNEFAEWFVEYLENKDYQKFYNAEEYRMRDADFKKNAVIKKQKLKDFYTLQMVNYLLKEVFGKDEMNLQLSELFQTRQERLKLQGIAKKQMNKETGDSSENTRNQTYIWNKDVPVSFFNGKVTIDKVKLKNIGKYKRYERDERVKTFIGYEVDEKWMMYLPHNWKDRYSVKPINVIDLQIQEYEEIRSHELLKEIQNLEQYIYDHTTDKNILLQDGNPNFKMYVLNGLLIGIKQVNIPDFIVLKQNTNFDKIDFTGIASCSELEKKTIILIAIRNKFAHNQLPNKMIYDLANEFLKIEKNETYANYYLKVLKKMISDLA

SEQ ID NO: 119 - protein, 948 aa, Riemerella anatipestifer
MFFSFHNAQRVIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKHQPWEPYQYCLLLKVPKENRKNLVKGWEQGGISLPRGLFTEAIRETLSKDLTLSKPIRKEIKKHGRVGFISRAITLYFKEKYQDKHQSFYNLSYKLEAKAPLLKKEEHYEYWQQNKPQSPTESQRLELHTSDRWKDYLLYKRWQHLEKKLRLYRNQDIMLWLMTLELTKNHFKELNLNYHQLKLENLAVNVQEADAKLNPLNQTLPMVLPVKVYPTTAFGEVQYHETPIRTVYIREEQTKALKMGNFKALVKDRRLNGLFSFIKEENDTQKHPISQLRLRRELEIYQSLRVDAFKETLSLEEKLLNKHASLSSLENEFRTLLEEWKKKYAASSMVTDKHIAFIASVRNAFCHNQYPFYKETLHAPILLFTVAQPTTEEKDGLGIAEALLKVLREYCEIVKSQI

SEQ ID NO: 120 - protein, 1139 aa, Prevotella pleuritidis
MENDKRLEESACYTLNDKHFWAAFLNLARHNVYITVNHINKTLELKNKKNQEIIIDNDQDILAIKTHWAKVNGDLNKTDRLRELMIKHFPFLEAAIYSNNKEDKEEVKEEKQAKAQSFKSLKDCLFLFLEKLQEARNYYSHYKYSESSKEPEFEEGLLEKMYNTFDASIRLVKEDYQYNKDIDPEKDFKHLERKEDFNYLFTDKDNKGKITKNGLLFFVSLFLEKKDAIWMQQKFRGFKDNRGNKEKMTHEVFCRSRMLLPKIRLESTQTQDWILLDMLNELIRCPKSLYERLQGAYREKFKVPFDSIDEDYDAEQEPFRNTLVRHQDRFPYFALRYFDYNEIFKNLRFQIDLGTYHFSIYKKLIGGKKEDRHLTHKLYGFERIQEFTKQNRPDKWQAIIKDLDTYETSNERYISETTPHYHLENQKIGIRFRNDNNDIWPSLKTNGEKNEKSKYNLDKPYQAEAFLSVHELLPMMFYYLLLKMENTDNDKEDNEVGTKKKGNKNNKQEKHKIEEIIENKIKDIYALYDAFTNGEINSIDELAEQREGKDIEIGHLPKQLIVILKNKSKDMAEKANRKQKEMIKDTKKRLATLDKQVKGEIEDGGRNIRLLKSGEIARWLVNDMMRFQPVQKDNEGKPLNNSKANSTEYQMLQRSLALYNKEEKPTRYFRQVNLIKSSNPHPFLEDTKWEECYNILSFYRNYLKAKIKFLNKLKPEDWKKNQYFLMLKEPKTNRKTLVQGWKNGFNLPRGIFTEPIKEWFKRHQNDSEEYKKVEALDRVGLVAKVIPLFFKEEYFKEDAQKEINNCVQPFYSFPYNVGNIHKPEEKNFLHCEERRKLWDKKKDKFKGYKAKEKSKKMTDKEKEEHRSYLEFQSWNKFERELRLVRNQDILTWLLCTKLIDKLKIDELNIEELQKLRLKDIDTDTAKKEKNNILNRVMPMRLPVTVYEIDKSFNIVKDKPLHTVYIEETGTKLLKQGNFKALVKDRRLNGLFSFVKTSSEAESKSKPISKLRVEYELGAYQKARIDIIKDMLALEKTLIDNDENLPTNKFSDMLKSWLKGKGEANKARLQNDVGLLVAVRNAFSHNQYPMYNSEVFKGMKLLSLSSDIPEKEGLGIAKQLKDKIKETIERIIEIEKEIRN

SEQ ID NO: 121 - protein, 1135 aa, Porphyromonas gingivalis; identical to SEQ ID NO: 99

SEQ ID NO: 122 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTNENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSGFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 123 - protein, 1135 aa, Porphyromonas gingivalis; identical to SEQ ID NO: 100

SEQ ID NO: 124 - protein, 1135 aa, Porphyromonas gingivalis; identical to SEQ ID NO: 101

SEQ ID NO: 125 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPRSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 126 - protein, 1133 aa, Prevotella falsenii
MKNDNNSTKSTDYTLGDKHFWAAFLNLARHNVYITVNHINKVLELKNKKDQEIIIDNDQDILAIKTLWGKVDTDINKKDRLRELIMKHFPFLEAATYQQSSTNNTKQKEEEQAKAQSFESLKDCLFLFLEKLREARNYYSHYKHSKSLEEPKLEEKLLENMYNIFDTNVQLVIKDYEHNKDINPEEDFKHLGRAEGEFNYYFTRNKKGNITESGLLFFVSLFLEKKDAIWAQTKIKGFKDNRENKQKMTHEVFCRSRMLLPKLRLESTQTQDWILLDMLNELIRCPKSLYKRLQGEKREKFRVPFDPADEDYDAEQEPFKNTLVRHQDRFPYFALRYFDYNEIFTNLRFQIDLGTYHFSIYKKQIGDKKEDRHLTHKLYGFERIQEFAKENRPDEWKALVKDLDTFEESNEPYISETTPHYHLENQKIGIRNKNKKKKKTIWPSLETKTTVNERSKYNLGKSFKAEAFLSVHELLPMMFYYLLLNKEEPNNGKINASKVEGIIEKKIRDIYKLYGAFANEEINNEEELKEYCEGKDIAIRHLPKQMIAILKNEYKDMAKKAEDKQKKMIKDTKKRLAALDKQVKGEVEDGGRNIKPLKSGRIASWLVNDMMRFQPVQRDRDGYPLNNSKANSTEYQLLQRTLALFGSERERLAPYFRQMNLIGKDNPHPFLKDTKWKEHNNILSFYRSYLEAKKNFLGSLKPEDWKKNQYFLKLKEPKTNRETLVQGWKNGFNLPRGIFTEPIREWFIRHQNESEEYKKVKDFDRIGLVAKVIPLFFKEDYQKEIEDYVQPFYGYPFNVGNIHNSQEGTFLNKKEREELWKGNKTKFKDYKTKEKNKEKTNKDKFKKKTDEEKEEFRSYLDFQSWKKFERELRLVRNQDIVTWLLCMELIDKLKIDELNIEELQKLRLKDIDTDTAKKEKNNILNRIMPMELPVTVYETDDSNNIIKDKPLHTIYIKEAETKLLKQGNFKALVKDRRLNGLFSFVETSSEAELKSKPISKSLVEYELGEYQRARVEIIKDMLRLEETLIGNDEKLPTNKFRQMLDKWLEHKKETDDTDLKNDVKLLTEVRNAFSHNQYPMRDRIAFANIKPFSLSSANTSNEEGLGIAKKLKDKTKETIDRIIEIEEQTATKR

SEQ ID NO: 127 - protein, 1116 aa, Prevotella pleuritidis
MENDKRLEESTCYTLNDKHFWAAFLNLARHNVYITINHINKLLEIRQIDNDEKVLDIKALWQKVDKDINQKARLRELMIKHFPFLEAAIYSNNKEDKEEVKEEKQAKAQSFKSLKDCLFLFLEKLQEARNYYSHYKSSESSKEPEFEEGLLEKMYNTFGVSIRLVKEDYQYNKDIDPEKDFKHLERKEDFNYLFTDKDNKGKITKNGLLFFVSLFLEKKDAIWMQQKLRGFKDNRGNKEKMTHEVFCRSRMLLPKIRLESTQTQDWILLDMLNELIRCPKSLYERLQGAYREKFKVPFDSIDEDYDAEQEPFRNTLVRHQDRFPYFALRYFDYNEIFKNLRFQIDLGTYHFSIYKKLIGDNKEDRHLTHKLYGFERIQEFAKQKRPNEWQALVKDLDIYETSNEQYISETTPHYHLENQKIGIRFKNKKDKIWPSLETNGKENEKSKYNLDKSFQAEAFLSIHELLPMMFYDLLLKKEEPNNDEKNASIVEGFIKKEIKRMYAIYDAFANEEINSKEGLEEYCKNKGFQERHLPKQMIAILTNKSKNMAEKAKRKQKEMIKDTKKRLATLDKQVKGEIEDGGRNIRLLKSGEIARWLVNDMMRFQSVQKDKEGKPLNNSKANSTEYQMLQRSLALYNKEQKPTPYFIQVNLIKSSNPHPFLEETKWEECNNILSFYRSYLEAKKNFLESLKPEDWKKNQYFLMLKEPKTNRKTLVQGWKNGFNLPRGIFTEPIKEWFKRHQNDSEEYKKVEALDRVGLVAKVIPLFFKEEYFKEDAQKEINNCVQPFYSFPYNVGNIHKPEEKNFLHCEERRKLWDKKKDKFKGYKAKEKSKKMTDKEKEEHRSYLEFQSWNKFERELRLVRNQDIVTWLLCTELIDKLKIDELNIEELQKLRLKDIDTDTAKKEKNNILNRIMPMQLPVTVYEIDKSFNIVKDKPLHTIYIEETGTKLLKQGNFKALVKDRRLNGLFSFVKTSSEAESKSKPISKLRVEYELGAYQKARIDIIKDMLALEKTLIDNDENLPTNKFSDMLKSWLKGKGEANKARLQNDVDLLVAIRNAFSHNQYPMYNSEVFKGMKLLSLSSDIPEKEGLGIAKQLKDKIKETIERIIEIEKEIRN

SEQ ID NO: 128 - protein, 1119 aa, Porphyromonas gingivalis
MTEQNERPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRYGNNDNPFFKHHFVDREGTVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPIDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDKNFRKMLESWSDPLLDKWPDLHRKVRLLIAVRNAFSHNQYPMYDEAVFSSIRKYDPSSPDAIEERMGLNIAHRLSEEVKQAKEMAERIIQV

SEQ ID NO: 129 - protein, 1175 aa, Porphyromonas gulae
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRMDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKNMEEKVRKKLQEMIADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHDTRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRTNVQEQGSLNVLNHVKPMRLPVVVYRADSRGHVHKEEAPLATVYIEERDTKLLKQGNFKSFVKDRRLNGLFSFVDTGGLAMEQYPISKLRVEYELAKYQTARVCAFEQTLELEESLLTRYPHLPDKNFRKMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 130 - protein, 1119 aa, Porphyromonas gulae
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHRHFNHLVRKGKKDRYGHNDNPSFKHHFVDGEGMVTEAGLLFFVSLFLEKRDAIWMQKKIRGFKGGTETYQQMTNEVFCRSRISLPKLKLESLRTDDWMLLDMLNELVRCPKPLYDRLREKDRARFRVPVDILPDEDDTDGGGEDPFKNTLVRHQDRFPYFALRYFDLKKVFTSLRFHIDLGTYHFAIYKKVIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTRDELDACLADKGIRRGHLPKQMIGILSQEHKNMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLDETRWESHTNILSFYRSYLRARKAFLERIGRSDRVENRPFLLLKEPKTDRQTLVAGWKSEFHLPRGIFTEAVRDCLIEMGYDEVGSYKEVGFMAKAVPLYFERACKDRVQPFYDSPFNVGNSLKPKKGRFLSKEKRAEEWESGKERFRLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 131 - protein, 1119 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHYHFNHLVRKGKKDRYGHNDNPSFKHHFVDSEGMVTEAGLLFFVSLFLEKRDAIWMQKKIRGFKGGTGPYEQMTNEVFCRSRISLPKLKLESLRTDDWMLLDMLNELVRCPKPLYDRLREKDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFMPEGQHLWPSPEVGTTRTGRSKYAQDKRLTAEAFLSVHELMPMMFYYFLLREKYSEEVSAEKVQGRIKRVIKDVYAIYDAFARDEINTLKELDACSADKGIRRGHLPKQMIGILSQEHKNMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLDETRWESHTNILSFYRSYLRARKAFLERIGRSDRVENRPFLLLKEPKNDRQTLVAGWKSEFHLPRGIFTEAVRDCLIEMGYDEVGSYKEVGFMAKAVPLYFERACKDRVQPFYDSPFNVGNSLKPKKGRFLSKEKRAEEWESGKERFRLAKLKKEILEAKEHPYHDFKSWQKFERELRLVKNQDIITWMMCRDLMEENKVEGLDTGTLYLKDIRTDVHEQGSLNVLNRVKPMRLPVVVYRADSRGHVHKEQAPLATVYIEERDTKLLKQGNFKSFVKDRRLNGLFSFVDTGGLAMEQYPISKLRVEYELAKYQTARVCAFEQTLELEESLLTRYPHLPDENFREMLESWSDPLLGKWPDLHGKVRLLIAVRNAFSHNQYPMYDEAVFSSIRKYDPSSPDAIEERMGLNIAHRLSEEVKQAKETVERIIQA

SEQ ID NO: 132 - protein, 1175 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDGEGMVTEAGLLFFVSLFLEKRDAIWMQKKIRGFKGGTETYQQMTNEVFCRSRISLPKLKLESLRTDDWMLLDMLNELVRCPKPLYDRLREDDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTSPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKDMEEKIRKKLQEMIADTDHRLDMLDRQTDRKIRIGRKNAGLPKSGVIADWLVRDMMRFQPVAKDTSGKPLNNSKANSTEYRMLQRALALFGGEKKRLTPYFRQMNLTGGNNPHPFLHETRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFRKMLESWSDPLLAKWPELHGKVRLLIAVRNAFSHNQYPMYDEAVFSSIRKYDPSSPDAIEERMGLNIAHRLSEEVKQAKETVERIIQV

SEQ ID NO: 133 - protein, 1119 aa, Porphyromonas gulae
MTEQSERPYNGTYYTLEDKHFWAAFLNLARHNAYITLTHIDRQLAYSKADITNDEDILFFKGQWKNLDNDLERKSRLRSLILKHFSFLEGAAYGKKFFESKSSGNKSSKNKELTKKEKEELQANALSLDNLKSILFDFLQKLKDFRNYYSHYRHSGSSELPLFDGNMLQRLYNVFDVSVQRVKRDHEHNDEVDPHYHFNHLVRKGKKDRYGHNDNPSFKHHFVDGEGMVTEAGLLFFVSLFLEKRDAIWMQKKIRGFKGGTEPYEQMTNEVFCRSRISLPKLKLESLRTDDWMLLDMLNELVRCPKPLYDRLREKDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFVPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIGILSQERKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKGEFHLPRGIFTEAVRDCLIEMGYDEVGSYREVGFMAKAVPLYFERACEDRVQPFYDSPFNVGNSLKPKKGRFLSKEKRAEEWESGKERFRLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDESFREMLESWSDPLLTKWPELHGKVRLLIAVRNAFSHNQYPMYDEAVFSSIWKYDPSSPDAIEERMGLNIAHRLSEEVKQAKETIERIIQA

SEQ ID NO: 134 - protein, 1174 aa, Porphyromonas gulae
MTEQSERPYNGTYYTLEDKHFWAAFLNLARHNAYITLTHIDRQLAYSKADITNDQDVLSFKALWKNLDNDLERKSRLRSLILKHFSFLEGAAYGKKLFESKSSGNKSSKNKELTKKEKEELQANALSLDNLKSILFDFLQKLKDFRNYYSHYRHSGSSELPLFDGNMLQRLYNVFDVSVQRVKRDHEHNDKVDPHYHFNHLVRKGKKDRYGHNDNPSFKHHFVDSEGMVTEAGLLFFVSLFLEKRDAIWMQKKIRGFKGGTGPYEQMTNEVFCRSRISLPKLKLESLRTDDWMLLDMLNELVRCPKPLYDRLREKDRACFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYLETGDKPYISQTTPHYHIEKGKIGLRFVPEGQHLWPSPEVGTTRTGRSKCAQDKRLTAEAFLSVHELMPMMFYYFLLREKYSEEVSAEKVQGRIKRVIEDVYAIYDAFARDEINTLKELDTCLADKGIRRGHLPKQMITILSQERKDMKEKIRKKLQEMIADTDHRLDMLDRQTDRKIRIGRKNAGLPKSGVIADWLVRDMMRFQPVAKDASGKPLNNSKANSTEYRMLQRALALFGGEKERLTPYFRQMNLTGGNNPHPFLHETRWESHTNILSFYRSYLRARKAFLERIGRSDRVENCPFLLLKEPKTDRQTLVAGWKDEFHLPRGIFTEAVRDCLIEMGYDEVGSYREVGFMAKAVPLYFERACEDRVQPFYDSPFNVGNSLKPKKGRFLSKEDRAEEWERGMERFRDLEAWSHSAARRIKDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEAPLATVYIEERNTKLLKQGNFKSFVKDRRLNGLFSFVDTGGLAMEQYPISKLRVEYELAKYQTARVCVFELTLRLEESLLSRYPHLPDESFREMLESWSDPLLAKWPELHGKVRLLIAVRNAFSHNQYPMYDEAVFSSIRKYDPSSPDAIEERMGLNIAHRLSEEVKQAKETVERIIQA

SEQ ID NO: 135 - protein, 1135 aa, Porphyromonas gulae
MNTVPATENKGQSRTVEDDPQYFGLYLNLARENLIEVESHVRIKFGKKKLNEESLKQSLLCDHLLSIDRWTKVYGHSRRYLPFLHCFDPDSGIEKDHDSKTGVDPDSAQRLIRELYSLLDFLRNDFSHNRLDGTTFEHLKVSPDISSFITGAYTFACERAQSRFADFFKPDDFLLAKNRKEQLISVADGKECLTVSGFAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSDFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVRDKKRELRTAGKPVPPDLAAYIKRSFHRAVNEREFMLRLVQEDDRLMLMAINKMMTDREEDILPGLKNIDSILDEENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDHENRFFGKLLNNMSQPINDL

SEQ ID NO: 136 - protein, 1218 aa, Capnocytophaga cynodegmi
MENKTSLGNNIYYNPFKPQDKSYFAGYLNAAMENIDSVFRELGKRLKGKEYTSENFFDAIFKENISLVEYERYVKLLSDYFPMARLLDKKEVPIKERKENFKKNFRGIIKAVRDLRNFYTHKEHGEVEITDEIFGVLDEMLKSTVLTVKKKKIKTDKTKEILKKSIEKQLDILCQKKLEYLKDTARKIEEKRRNQRERGEKKLVPRFEYSDRRDDLIAAIYNDAFDVYIDKKKDSLKESSKTKYNTESYPQQEEGDLKIPISKNGVVFLLSLFLSKQEVHAFKSKIAGFKATVIDEATVSHRKNSICFMATHEIFSHLAYKKLKRKVRTAEINYSEAENAEQLSIYAKETLMMQMLDELSKVPDVVYQNLSEDVQKTFIEDWNEYLKENNGDVGTMEEEQVIHPVIRKRYEDKFNYFAIRFLDEFAQFPTLRFQVHLGNYLHDSRPKEHLISDRRIKEKITVFGRLSELEHKKALFIKNTETNEDRKHYWEVFPNPNYDFPKENISVNDKDFPIAGSILDREKQPTAGKIGIKVNLLNQKYISEVDKAVKAHQLKQRNNKPSIQNIIEEIVPINGSNPKEIIVFGGQPTAYLSMNDIHSILYEFFDKWEKKKEKLEKKGEKELRKEIGKELEEKIVGKIQTQIQQIIDKDINAKILKPYQDDDSTAIDKEKLIKDLKQEQKILQKLKNEQTAREKEYQECIAYQEESRKIKRSDKSRQKYLRNQLKRKYPEVPTRKEILYYQEKGKVAVWLANDIKRFMPTDFKNEWKGEQHSLLQKSLAYYEQCKEELKNLLPQQKVFKHLPFELGGHFQQKYLYQFYTRYLDKRLEHISGLVQQAENFKNENKVFKKVENECFKFLKKQNYTHKGLDAQAQSVLGYPIFLERGFMDEKPTIIKGKTFKGNESLFTDWFRYYKEYQNFQTFYDTENYPLVELEKKQADRKRETKIYQQKKNDVFTLLMAKHIFKSVFKQDSIDRFSLEDLYQSREERLENQEKAKQTGERNTNYIWNKTVDLNLCDGKVTVENVKLKNVGNFIKYEYDQRVQTFLKYEENIKWQAFLIKESKEEENYPYIVEREIEQYEKVRREELLKEVHLIEEYILEKVKDKEILKKGDNQNFKYYILNGLLKQLKNEDVESYKVFNLNTKPEDVNINQLKQEATDLEQKAFVLTYIRNKFAHNQLPKKEFWDYCQEKYGKIEKEKTYAEYFAEVFKREKEALMK

SEQ ID NO: 137 - protein, 1090 aa, Prevotella species
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLIDGCEFLTSTEQPLSGMISKYYTVALRNTKERYGYKTEDLAFIQDNIKKITKDAYGKRKSQVNTGFFLSLQDYNGDTQKKLHLSGVGIALLICLFLDKQYINIFLSRLPIFSSYNAQSEERRIIIRSFGINSIKLPKDRIHSEKSNKSVAMDMLNEVKRCPDELFTTLSAEKQSRFRIISDDHNEVLMKRSTDRFVPLLLQYIDYGKLFDHIRFHVNMGKLRYLLKADKTCIDGQTRVRVIEQPLNGFGRLEEAETMRKQENGTFGNSGIRIRDFENVKRDDANPANYPYIVDTYTHYILENNKVEMFISDKGSSAPLLPLIEDDRYVVKTIPSCRMSTLEIPAMAFHMFLFGSKKTEKLIVDVHNRYKRLFQAMQKEEVTAENIASFGIAESDLPQKILDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFARSIPANAVDFYERYLIERKFYLTGLCNEIKRGNRVDVPFIRRDQNKWKTPAMKTLGRIYSEDLPVELPRQMFDNEIKSHLKSLPQMEGIDFNNANVTYLIAEYMKRVLNDDFQTFYQWKRNYHYMDMLKGEYDRKGSLQHCFTSVEEREGLWKERASRTERYRKLASNKIRSNRQMRNASSEEIETILDKRLSNCRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDIVSKEDIMEEFNKYDQCRPEISSIVFNLEKWAFDTYPELSARVDREEKVDFKSILKILLNNKNINKEQSDILRKIRNAFDHNNYPDKGIVEIKALPEIAMSIKKAFGEYAIMK

SEQ ID NO: 138 - protein, 1090 aa, Prevotella species
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDQASHYKTYDEKLIDGCEFLTSTEQPLSGMINNYYTVALRNMNERYGYKTEDLAFIQDKRFKFVKDAYGKKKSQVNTGFFLSLQDYNGDTQKKLHLSGVGIALLICLFLDKQYINIFLSRLPIFSSYNAQSEERRIIIRSFGINSIKQPKDRIHSEKSNKSVAMDMLNEIKRCPNELFETLSAEKQSRFRIISNDHNEVLMKRSSDRFVPLLLQYIDYGKLFDHIRFHVNMGKLRYLLKADKTCIDGQTRVRVIEQPLNGFGRLEEVETMRKQENGTFGNSGIRIRDFENMKRDDANPANYPYIVDTYTHYILENNKVEMFISDEETPAPLLPVIEDDRYVVKTIPSCRMSTLEIPAMAFHMFLFGSKKTEKLIVDVHNRYKRLFKAMQKEEVTAENIASFGIAESDLPQKIIDLISGNAHGKDVDAFIRLTVDDMLADTERRIKRFKDDRKSIRSADNKMGKRGFKQISTGKLADFLAKDIVLFQPSVNDGENKITGLNYRIMQSAIAVYNSGDDYEAKQQFKLMFEKARLIGKGTTEPHPFLYKVFVRSIPANAVDFYERYLIERKFYLIGLSNEIKKGNRVDVPFIRRDQNKWKTPAMKTLGRIYDEDLPVELPRQMFDNEIKSHLKSLPQMEGIDFNNANVTYLIAEYMKRVLNDDFQTFYQWKRNYRYMDMLRGEYDRKGSLQSCFTSVEEREGLWKERASRTERYRKLASNKIRSNRQMRNASSEEIETILDKRLSNSRNEYQKSEKVIRRYRVQDALLFLLAKKTLTELADFDGERFKLKEIMPDAEKGILSEIMPMSFTFEKGGKKYTITSEGMKLKNYGDFFVLASDKRIGNLLELVGSDTVSKEDIMEEFKKYDQCRPEISSIVFNLEKWAFDTYPELSARVDREEKVDFKSILKILLNNKNINKEQSDILRKIRNAFDHNNYPDKGVVEIRALPEIAMSIKKAFGEYAIMK

SEQ ID NO: 139 - protein, 1090 aa, Prevotella species
MNIPALVENQKKYFGTYSVMAMLNAQTVLDHIQKVADIEGEQNENNENLWFHPVMSHLYNAKNGYDKQPEKTMFIIERLQSYFPFLKIMAENQREYSNGKYKQNRVEVNSNDIFEVLKRAFGVLKMYRDLTNHYKTYEEKLIDGCEFLTSTEQPFSGMISKYYTVALRNTKERYGYKAEDLAFIQDNRYKFTKDAYGKRKSQVNTGSFLSLQDYNGDTTKKLHLSGVGIALLICLFLDKQYINLFLSRLPIFSSYNAQSEERRIIIRSFGINSIKQPKDRIHSEKSNKSVAMDMLNEVKRCPDELFTTLSAEKQSRFRIISDDHNEVLMKRSSDRFVPLLLQYIDYGKLFDHIRFHVNMGKLRYLLKADKTCIDGQTRVRVIEQPLNGFGRLEEVETMRKQENGTFGNSGIRIRDFENMKRDDANPANYPYIVETYTHYILENNKVEMFISDEENPTPLLPVIEDDRYVVKTIPSCRMSTLEIPAMAFHMFLFGSEKTEKLIIDVHDRYKRLFQAMQKEEVTAENIASFGIAESDLPQKIMDLISGNAHGKDVDAFIRLTVDDMLTDTERRIKRFKDDRKSIRSADNKMGKRGFKQISTGKLADFLAKDIVLFQPSVNDGENKITGLNYRIMQSAIAVYDSGDDYEAKQQFKLMFEKARLIGKGTTEPHPFLYKVFVRSIPANAVDFYERYLIERKFYLIGLSNEIKKGNRVDVPFIRRDQNKWKTPAMKTLGRIYSEDLPVELPRQMFDNEIKSHLKSLPQMEGIDFNNANVTYLIAEYMKRVLNDDFQTFYQWKRNYRYMDMLRGEYDRKGSLQHCFTSIEEREGLWKERASRTERYRKLASNKIRSNRQMRNASSEEIETILDKRLSNCRNEYQKSEKIIRRYRVQDALLFLLAKKTLTELADFDGERFKLKEIMPDAEKGILSEIMPMSFTFEKGGKIYTITSGGMKLKNYGDFFVLASDKRIGNLLELVGSNTVSKEDIMEEFKKYDQCRPEISSIVFNLEKWAFDTYPELPARVDRKEKVDFWSILDVLSNNKDINNEQSYILRKIRNAFDHNNYPDKGIVEIKALPEIAMSIKKAFGEYAIMK

SEQ ID NO: 140 - protein, 1131 aa, Phaeodactylibacter xiamenensis
MTNTPKRRTLHRHPSYFGAFLNIARHNAFMIMEHLSTKYDMEDKNTLDEAQLPNAKLFGCLKKRYGKPDVTEGVSRDLRRYFPFLNYPLFLHLEKQQNAEQAATYDINPEDIEFTLKGFFRLLNQMRNNYSHYISNTDYGKFDKLPVQDIYEAAIFRLLDRGKHTKRFDVFESKHTRHLESNNSEYRPRSLANSPDHENTVAFVTCLFLERKYAFPFLSRLDCFRSTNDAAEGDPLIRKASHECYTMFCCRLPQPKLESSDILLDMVNELGRCPSALYNLLSEEDQARFHIKREEITGFEEDPDEELEQEIVLKRHSDRFPYFALRYFDDTEAFQTLRFDVYLGRWRTKPVYKKRIYGQERDRVLTQSIRTFTRLSRLLPIYENVKHDAVRQNEEDGKLVNPDVTSQFHKSWIQIESDDRAFLSDRIEHFSPHYNFGDQVIGLKFINPDRYAAIQNVFPKLPGEEKKDKDAKLVNETADAIISTHEIRSLFLYHYLSKKPISAGDERRFIQVDTETFIKQYIDTIKLFFEDIKSGELQPIADPPNYQKNEPLPYVRGDKEKTQEERAQYRERQKEIKERRKELNTLLQNRYGLSIQYIPSRLREYLLGYKKVPYEKLALQKLRAQRKEVKKRIKDIEKMRTPRVGEQATWLAEDIVFLTPPKMHTPERKTTKHPQKLNNDQFRIMQSSLAYFSVNKKAIKKFFQKETGIGLSNRETSHPFLYRIDVGRCRGILDFYTGYLKYKMDWLDDAIKKVDNRKHGKKEAKKYEKYLPSSIQHKTPLELDYTRLPVYLPRGLFKKAIVKALAAHADFQVEPEEDNVIFCLDQLLDGDTQDFYNWQRYYRSALTEKETDNQLVLAHPYAEQILGTIKTLEGKQKNNKLGNKAKQKIKDELIDLKRAKRRLLDREQYLRAVQAEDRALWLMIQERQKQKAEHEEIAFDQLDLKNITKILTESIDARLRIPDTKVDITDKLPLRRYGDLRRVAKDRRLVNLASYYHVAGLSEIPYDLVKKELEEYDRRRVAFFEHVYQFEKEVYDRYAAELRNENPKGESTYFSHWEYVAVAVKHSADTHFNELFKEKVMQLRNKFHHNEFPYFDWLLPEVEKASAALYADRVFDVAEGYYQKMRKLMRQ

SEQ ID NO: 141 - protein, 1155 aa, Flavobacterium species
MDNNITVEKTELGLGITYNHDKVEDKHYFGGFFNLAQNNIDLVAQEFKKRLLIQGKDSINIFANYFSDQCSITNLERGIKILAEYFPVVSYIDLDEKNKSKSIREHLILLLETINNLRNYYTHYYHKKIIIDGSLFPLLDTILLKVVLEIKKKKLKEDKTKQLLKKGLEKEMTILFNLMKAEQKEKKIKGWNIDENIKGAVLNRAFSHLLYNDELSDYRKSKYNTEDETLKDTLTESGILFLLSFFLNKKEQEQLKANIKGYKGKIASIPDEEITLKNNSLRNMATHWTYSHLTYKGLKHRIKTDHEKETLLVNMVDYLSKVPHEIYQNLSEQNKSLFLEDINEYMRDNEENHDSSEASRVIHPVIRKRYENKFAYFAIRFLDEFAEFPTLRFMVNVGNYIHDNRKKDIGGTSLITNRTIKQQINVFGNLTEIHKKKNDYFEKEENKEKTLEWELFPNPSYHFQKENIPIFIDLEKSKETNDLAKEYAKEKKKIFGSSRKKQQNTAKKNRETIINLVFDKYKTSDRKTVTFEQPTALLSFNELNSFLYAFLVENKTGKELEKIIIEKIANQYQILKNCSSTVDKTNDNIPKSIKKIVNTTTDSFYFEGKKIDIEKLEKDITIEIEKTNEKLETIKENEESAQNYKRNERNTQKRKLYRKYVFFTNEIGIEATWITNDILRFLDNKENWKGYQHSELQKFISQYDNYKKEALGLLESEWNLESDAFFGQNLKRMFQSNSTFETFYKKYLDNRKNTLETYLSAIENLKTMTDVRPKVLKKKWTELFRFFDKKIYLLSTIETKINELITKPINLSRGIFEEKPTFINGKNPNKENNQHLFANWFIYAKKQTILQDFYNLPLEQPKAITNLKKHKYKLERSINNLKIEDIYIKQMVDFLYQKLFEQSFIGSLQDLYTSKEKREIEKGKAKNEQTPDESFIWKKQVEINTHNGRIIAKTKIKDIGKFKNLLTDNKIAHLISYDDRIWDFSLNNDGDITKKLYSINTELESYETIRREKLLKQIQQFEQFLLEQETEYSAERKHPEKFEKDCNPNFKKYIIEGVLNKIIPNHEIEEIEILKSKEDVFKINFSDILILNNDNIKKGYLLIMIRNKFAHNQLIDKNLFNFSLQLYSKNENENFSEYLNKVCQNIIQEFKEKLK

SEQ ID NO: 142 - protein, 1175 aa, Porphyromonas gulae
MTEQSERPYNGTYYTLEDKHFWAAFLNLARHNAYITLTHIDRQLAYSKADITNDQDVLSFKALWKNFDNDLERKSRLRSLILKHFSFLEGAAYGKKLFESKSSGNKSSKNKELTKKEKEELQANALSLDNLKSILFDFLQKLKDFRNYYSHYRHSESSELPLFDGNMLQRLYNVFDVSVQRVKRDHEHNDKVDPHRHFNHLVRKGKKDRYGHNDNPSFKHHFVDSEGMVTEAGLLFFVSLFLEKRDAIWMQKKIRGFKGGTETYQQMTNEVFCRSRISLPKLKLESLRTDDWMLLDMLNELVRCPKPLYDRLREKDRARFRVPVDILPDEDDTDGGGEDPFKNTLVRHQDRFPYFALRYFDLKKVFTSLRFHIDLGTYHFAIYKKMIGEQPEDRHLTRNLYGFGRIQDFAEEHRPEEWKRLVRDLDYFETGDKPYISQTTPHYHIEKGKIGLRFMPEGQHLWPSPEVGTTRTGRSKYAQDKRLTAEAFLSVHELMPMMFYYFLLREKYSEEVSAEKVQGRIKRVIEDVYAIYDAFARDEINTLKELDACLADKGIRRGHLPKQMIAILSQEHKDMEEKIRKKLQEMIADTDHRLDMLDRQTDRKIRIGRKNAGLPKSGVIADWLVRDMMRFQPVAKDTSGKPLNNSKANSTEYRMLQRALALFGGEKKRLTPYFRQMNLTGGNNPHPFLHETRWESHTNILSFYRSYLRARKAFLERIGRSDRMENRPFLLLKEPKTDRQTLVAGWKSEFHLPRGIFTEAVRDCLIEMGYDEVGSYREVGFMAKAVPLYFERACEDRVQPFYDSPFNVGNSLKPKKGRFLSKEERAEEWERGKERFRDLEAWSHSAARRIEDAFAGIEYASPGNKKKIEQLLRDLSLWEAFESKLKVRADKINLAKLKKEILEAQEHPYHDFKSWQKFERELRLVKNQDIITWMMCRDLMEENKVEGLDTGTLYLKDIRPNVQEQGSLNVLNRVKPMRLPVVVYRADSRGHVHKEEAPLATVYIEERDTKLLKQGNFKSFVKDRRLNGLFSFVDTGGLAMEQYPISKLRVEYELAKYQTARVCVFELTLRLEESLLTRYPHLPDESFRKMLESWSDPLLAKWPELHGKVRLLIAVRNAFSHNQYPMYDEAVFSSIRKYDPSSPDAIEERMGLNIAHRLSEEVKQAKETVERIIQV

SEQ ID NO: 143 - protein, 1145 aa, Chryseobacterium species
METQTIGHGIAYDHSKIQDKHFFGGFLNLAENNIKAVLKAFSEKFNVGNVDVKQFADVSLKDNLPDNDFQKRVSFLKMYFPVVDFINIPNNRAKFRSDLTTLFKSVDQLRNFYTHYYHKPLDFDASLFILLDDIFARTAKEVRDQKMKDDKTRQLLSKSLSEELQKGYELQLERLKELNRLGKKVNIHDQLGIKNGVLNNAFNHLIYKDGESFKTKLTYSSALTSFESAENGIEISQSGLLFLLSMFLKRKEIEDLKNRNKGFKAKVVIDEDGKVNGLKFMATHWVFSYLCFKGLKSKLSTEFHEETLLIQIIDELSKVPDELYCAFDKETRDKFIEDINEYVKEGHQDFSLEDAKVIHPVIRKRYENKFNYFAIRFLDEFVKFPSLRFQVHVGNYVHDRRIKNIDGTTFETERVVKDRIKVFGRLSEISSYKAQYLSSVSDKHDETGWEIFPNPSYVFINNNIPIHISVDTSFKKEIADFKKLRRAQVPDELKIRGAEKKRKFEITQMIGSKSVLNQEEPIALLSLNEIPALLYEILINGKEPAEIERIIKDKLNERQDVIKNYNPENWLPASQISRRLRSNKGERIINTDKLLQLVTKELLVTEQKLKIISDNREALKQKKEGKYIRKFIFTNSELGREAIWLADDIKRFMPADVRKEWKGYQHSQLQQSLAFYNSRPKEALAILESSWNLKDEKIIWNEWILKSFTQNKFFDAFYNEYLKGRKKYFAFLSEHIVQYTSNAKNLQKFIKQQMPKDLFEKRHYIIEDLQTEKNKILSKPFIFPRGIFDKKPTFIKGVKVEDSPESFANWYQYGYQKDHQFQKFYDWKRDYSDVFLEHLGKPFINNGDRRTLGMEELKERIIIKQDLKIKKIKIQDLFLRLIAENLFQKVFKYSAKLPLSDFYLTQEERMEKENMAALQNVREEGDKSPNIIKDNFIWSKMIPYKKGQIIENAVKLKDIGKLNVLSLDDKVQTLLSYDDAKPWSKIALENEFSIGENSYEVIRREKLFKEIQQFESEILFRSGWDGINHPAQLEDNRNPKFKMYIVNGILRKSAGLYSQGEDIWFEYNADFNNLDADVLETKSELVQLAFLVTAIRNKFAHNQLPAKEFYFYIRAKYGFADEPSVALVYLNFTKYAINEFKKVMI

SEQ ID NO: 144 - protein, 948 aa, Riemerella anatipestifer
MFFSFHNAQRVIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQREKMTTEVFCRSRILLPKLRLESRYDHNQMLLDMLSELSRCPKLLYEKLSEENKKHFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSNQPFISKTTPHYHITDNKIGFRLGTSKELYPSLEIKDGANRIAKYPYNSGFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIKSSKANSTEFWFIRRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSEDLMLSKPIRKEIKKHGRVGFISRAITLYFKEKYQDKHQSFYNLSYKLEAKAPLLKREEHYEYWQQNKPQSPTESQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYHKTPIRTVYIREEHTKALKMGNFKALVKDRRLNGLFSFIKEENDTQKHPISQLRLRRELEIYQSLRVDAFKETLSLEEKLLNKHTSLSSLENEFRALLEEWKKEYAASSMVTDEHIAFIASVRNAFCHNQYPFYKEALHAPIPLFTVAQPTTEEKDGLGIAEALLKVLREYCEIVKSQI

SEQ ID NO: 145 - protein, 1175 aa, Porphyromonas gingivalis
MTEQNEKPYNGTYYTLEDKHFWAAFFNLARHNAYITLAHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDKYGNNDNPFFKHHFVDREEKVTEAGLLFFVSLFLEKRDAIWMQKKIRGFKGGTEAYQQMTNEVFCRSRISLPKLKLESLRTDDWMLLDMLNELVRCPKLLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQLLWPSPEVGATRTGRSKYAQDKRFTAEAFLSVHELMPMMFYYFLLREKYSEEASAEKVQGRIKRVIEDVYAVYDAFARDEINTRDELDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRDLEAWSHSAARRIEDAFVGIEYASWENKKKIEQLLQDLSLWETFESKLKVKADKINIAKLKKEILEAKEHPYHDFKSWQKFERELRLVKNQDIITWMMCRDLMEENKVEGLDTGTLYLKDIRTDVQEQGSLNVLNHVKPMRLPVVVYRADSRGHVHKEEAPLATVYIEERDTKLLKQGNFKSFVKDRRLNGLFSFVDTGALAMEQYPISKLRVEYELAKYQTARVCAFEQTLELEESLLTRYPHLPDESFREMLESWSDPLLDKWPDLQREVRLLIAVRNAFSHNQYPMYDETIFSSIRKYDPSSLDAIEERMGLNIAHRLSEEVKLAKEMVERIIQA

SEQ ID NO: 146 - protein, 1175 aa, Porphyromonas gingivalis
MTEQNEKPYNGTYYTLKDKHFWAAFFNLARHNAYITLTHIDRQLAYSKADITNDEDILFFKGQWKNLDNDLERKARLRSLILKHFSFLEGAAYGKKLFESQSSGNKSSKKKELTKKEKEELQANALSLDNLKSILFDFLQKLKDFRNYYSHYRHPESSELPMFDGNMLQRLYNVFDVSVQRVKRDHEHNDKVDPHRHFNHLVRKGKKDRCGNNDNPFFKHHFVDREGKVTEAGLLFFVSLFLEKRDAIWMQKKIRGFKGGTETYQQMTNEVFCRSRISLPKLKLESLRTDDWMLLDMLNELVRCPKSLYDRLREEDRACFRVPVDILSDEDDTDGAEEDPFKNTLVRHQDRFPYFALRYFDLKKVFTSLRFHIDLGTYHFAIYKKNIGEQPEDRHLTRNLYGFGRIQDFAEEHRPEEWKRLVRDLDCFETGDKPYITQTTPHYHIEKGKIGLRFVPEGQHLWPSPEVGATRTGRSKYAQDKRFTAEAFLSVHELMPMMFYYFLLREKYSEEVSAERVQGRIKRVIEDVYAVYDAFARDEINTRDELDACLADKGIRRGHLPRQMIAILSQKHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDRVENHRFLLLKEPKTDRQTLVAGWKGEFHLPRGIFTEAVRDCLIEMGLDEVGSYKEVGFMAKAVPLYFERACKDRVQPFYDYPFNVGNSLKPKKGRFLSKEKRAEEWESGKERFRDLEAWSHSAARRIEDAFAGIENASRENKKKIEQLLQDLSLWETFESKLKVKADKINIAKLKKEILEAKEHPYLDFKSWQKFERELRLVKNQDIITWMMCRDLMEENKVEGLDTGTLYLKDIRTDVQEQGSLNVLNHVKPMRLPVVVYRADSRGHVHKEQAPLATVYIEERDTKLLKQGNFKSFVKDRRLNGLFSFVDTGALAMEQYPISKLRVEYELAKYQTARVCAFEQTLELEESLLTRYPHLPDENFRKMLESWSDPLLDKWPDLHRKVRLLIAVRNAFSHNQYPMYDEAVFSSIRKYDPSSPDAIEERMGLNIAHRLSEEVKQAKEMAERIIQA

SEQ ID NO: 147 - protein, 1213 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKVYDFLDDTLLDVLITIKKKKVKNDTSRELLKEKFRPELTQLKNQKREELIKKGKKLLEENLENAVFNHCLRPFLEENKTDDKQNKTVSLRKYRKSKPNEETSITLTQSGLVFLISFFLHRKEFQVFTSGLEGFKAKVNTIKEEEISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLGLVTEYKKNVYLKETSNIDLSRFPLFPSPSYVMANNNIPFYIDSRSNNLDEYLNQKKKAQSQNRKRNLTFEKYNKEQSKDAIIAMLQKEIGVKDLQQRSTIGLLSCNELPSMLYEVIVKDIKGAELENKIAQKIREQYQSIRDFTLDSPQKDNIPTTLTKTISTDTSVTFENQPIDIPRLKNALQKELTLTQEKLLNVKQHEIEVDNYNRNKNTYKFKNQPKDKVDDNKLQRKYVFYRNEIGQEANWLASDLIHFMKNKSLWKGYMHNELQSFLAFFEDKKNDCIALLETVFNLKEDCILTKDLKNLFLKHGNFIDFYKEYLKLKEDFLNTESTFLENGFIGLPPKILKKELSKRLNYIFIVFQKRQFIIKELEEKKNNLYADAINLSRGIFDEKPTMIPFKKPNPDEFASWFVASYQYNNYQSFYELTPDKIENDKKKKYKNLRAINKVKIQDYYLKLMVDTLYQDLFNQPLDKSLSDFYVSKTDREKIKADAKAYQKRNDSFLWNKVIHLSLQNNRITANPKLKDIGKYKRALQDEKIATLLTYDDRTWTYALQKPEKENENDYKELHYTALNMELQEYEKVRSKKLLKQVQELEKQILDKFYDFSNNATHPEDLEIEDKKGKRHPNFKLYITKALLKNESEIINLENIDIEILIKYYDYNTEKLKEKIKNMDEDEKAKIVNTKENYNKITNVLIKKALVLIIIRNKMAHNQYPPKFIYDLATRFVPKKEEEYFACYFNRVFETITTELWENKKKAKEIV

SEQ ID NO: 148 - protein, 1119 aa, Porphyromonas gingivalis
MTEQNERPYNGTYYTLEDKHFWAAFFNLARHNAYITLTHIDRQLAYSKADITNDEDILFFKGQWKNLDNDLERKARLRSLILKHFSFLEGAAYGKKLFENKSSGNKSSKKKELTKKEKEELQANALSLDNLKSILFDFLQKLKDFRNYYSHYRHPESSELPLFDGNMLQRLYNVFDVSVQRVKRDHEHNDKVDPHRHFNHLVRKGKKDRCGNNDNPFFKHHFVDREGKVTEAGLLFFVSLFLEKRDAIWMQKKIRGFKGGTEAYQQMTNEVFCRSRISLPKLKLESLRTDDWMLLDMLNELVRCPKSLYDRLREEDRARFRVPVDILSDEDDTDGTEEDPFKNTLVRHQDRFPYFALRYFDLKKVFTSLRFHIDLGTYHFAIYKKNIGEQPEDRHLTRNLYGFGRIQDFAEEHRPEEWKRLVRDLDYFETGDKPYITQTTPHYHIEKGKIGLRFVPEGQHLWPSPEVGATRTGRSKYAQDKRLTAEAFLSVHELMPMMFYYFLLREKYSEEVSAEKVQGRIKRVIEDVYAVYDAFARGEIDTLDRLDACLADKGIRRGHLPRQMIAILSQEHKDMEEKVRKKLQEMIADTDHRLDMLDRQTDRKIRIGRKNAGLPKSGVIADWLVRDMMRFQPVAKDTSGKPLNNSKANSTEYRMLQRALALFGGEKERLTPYFRQMNLTGGNNPHPFLHETRWESHTNILSFYRSYLKARKAFLQSIGRSDREENHRFLLLKEPKTDRQTLVAGWKSEFHLPRGIFTEAVRDCLIEMGYDEVGSYKEVGFMAKAVPLYFERACKDRVQPFYDYPFNVGNSLKPKKGRFLSKEKRAEEWESGKERFRLAKLKKEILEAKEHPYLDFKSWQKFERELRLVKNQDIITWMMCRDLMEENKVEGLDTGTLYLKDIRTEVQEQGSLNVLNRVKPMRLPVVVYRADSRGHVHKEQAPLATVYIEERDTKLLKQGNFKSFVKDRRLNGLFSFVDTGGLAMEQYPISKLRVEYELAKYQTARVCAFEQTLELEESLLTRCPHLPDKNFRKMLESWSDPLLDKWPDLQREVWLLIAVRNAFSHNQYPMYDEAVFSSIRKYDPSSPDAIEERMGLNIAHRLSEEVKQAKEMAERIIQA

SEQ ID NO: 149 - protein, 1135 aa, Porphyromonas gingivalis
MNTVPASENKGQSRTVEDDPQYFGLYLNLARENLIEVESHVRIKFGKKKLNEESLKQSLLCDHLLSVDRWTKVYGHSRRYLPFLHYFDPDSQIEKDHDSKTGVDPDSAQRLIRELYSLLDFLRNDFSHNRLDGTTFEHLEVSPDISSFITGTYSLACGRAQSRFADFFKPDDFVLAKNRKEQLISVADGKECLTVSGLAFFICLFLDREQASGMLSRIRGFKRTDENWARAVHETFCDLCIRHPHDRLESSNTKEALLLDMLNELNRCPRILYDMLPEEERAQFLPALDENSMNNLSENSLNEESRLLWDGSSDWAEALTKRIRHQDRFPYLMLRFIEEMDLLKGIRFRVDLGEIELDSYSKKVGRNGEYDRTITDHALAFGKLSDFQNEEEVSRMISGEASYPVRFSLFAPRYAIYDNKIGYCHTSDPVYPKSKTGEKRALSNPQSMGFISVHDLRKLLLMELLCEGSFSRMQSGFLRKANRILDETAEGKLQFSALFPEMRHRFIPPQNPKSKDRREKAETTLEKYKQEIKGRKDKLNSQLLSAFDMNQRQLPSRLLDEWMNIRPASHSVKLRTYVKQLNEDCRLRLRKFRKDGDGKARAIPLVGEMATFLSQDIVRMIISEETKKLITSAYYNEMQRSLAQYAGEENRRQFRAIVAELHLLDPSSGHPFLSATMETAHRYTEDFYKCYLEKKREWLAKTFYRPEQDENTKRRISVFFVPDGEARKLLPLLIRRRMKEQNDLQDWIRNKQAHPIDLPSHLFDSKIMELLKVKDGKKKWNEAFKDWWSTKYPDGMQPFYGLRRELNIHGKSVSYIPSDGKKFADCYTHLMEKTVQDKKRELRTAGKPVPPDLAADIKRSFHRAVNEREFMLRLVQEDDRLMLMAINKMMTDREEDILPGLKNIDSILDKENQFSLAVHAKVLEKEGEGGDNSLSLVPATIEIKSKRKDWSKYIRYRYDRRVPGLMSHFPEHKATLDEVKTLLGEYDRCRIKIFDWAFALEGAIMSDRDLKPYLHESSSREGKSGEHSTLVKMLVEKKGCLTPDESQYLILIRNKAAHNQFPCAAEMPLIYRDVSAKVGSIEGSSAKDLPEGSSLVDSLWKKYEMIIRKILPILDPENRFFGKLLNNMSQPINDL

SEQ ID NO: 150 - protein, 950 aa, Riemerella anatipestifer
MFFSFHNAQRVIFKHLYKAFDASLRMVKEDYKAHFTVNLTRDFAHLNRKGKNKQDNPDFNRYRFEKDGFFTESGLLFFTNLFLDKRDAYWMLKKVSGFKASHKQSEKMTTEVFCRSRILLPKLRLESRYDHNQMLLDMLSELSRCPKLLYEKLSEKDKKCFQVEADGFLDEIEEEQNPFKDTLIRHQDRFPYFALRYLDLNESFKSIRFQVDLGTYHYCIYDKKIGYEQEKRHLTRTLLNFGRLQDFTEINRPQEWKALTKDLDYNETSNQPFISKTTPHYHITDNKIGFRLRTSKELYPSLEVKDGANRIAKYPYNSDFVAHAFISISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVVYDAQNQPIKSSKANSTESRLIRRALALYGGEKNRLEGYFKQTNLIGNTNPHPFLNKFNWKACRNLVDFYQQYLEQREKFLEAIKHQPWEPYQYCLLLKVPKENRKNLVKGWEQGGISLPRGLFTEAIRETLSKDLTLSKPIRKEIKKHGRVGFISRAITLYFKEKYQDKHQSFYNLSYKLEAKAPLLKKEEHYEYWQQNKPQSPTESQRLELHTSDRWKDYLLYKRWQHLEKKLRLYRNQDIMLWLMTLELTKNHFKELNLNYHQLKLENLAVNVQEADAKLNPLNQTLPMVLPVKVYPTTAFGEVQYHETPIRTVYIREEQTKALKMGNFKALVKDRHLNGLFSFIKEENDTQKHPISQLRLRRELEIYQSLRVDAFKETLSLEEKLLNKHASLSSLENEFRTLLEEWKKKYAASSMVTDKHIAFIASVRNAFCHNQYPFYKETLHAPILLFTVAQPTTEEKDGLGIAEALLRVLREYCEIVKSQI

SEQ ID NO: 151 - protein, 1213 aa, Flavobacterium columnare
MSSKNESYNKQKTFNHYKQEDKYFFGGFLNNADDNLRQVGKEFKTRINFNHNNNELASVFKDYFNKEKSVAKREHALNLLSNYFPVLERIQKHTNHNFEQTREIFELLLDTIKKLRDYYTHHYHKPITINPKIYDFLDDTLLDVLITIKKKKVKNDTSRELLKEKLRPELTQLKNQKREELIKKGKKLLEENLENAVFNHCLRPFLEENKTDDKQNKTVSLRKYRKSKPNEETSITLTQSGLVFLMSFFLHRKEFQVFTSGLEGFKAKVNTIKEEKISLNKNNIVYMITHWSYSYYNFKGLKHRIKTDQGVSTLEQNNTTHSLTNTNTKEALLTQIVDYLSKVPNEIYETLSEKQQKEFEEDINEYMRENPENEDSTFSSIVSHKVIRKRYENKFNYFAMRFLDEYAELPTLRFMVNFGDYIKDRQKKILESIQFDSERIIKKEIHLFEKLGLVTEYKKNVYLKETSNIDLSRFPLFPSPSYVMANNNIPFYIDSRSNNLDEYLNQKKKAQSQNRKRNLTFEKYNKEQSKDAIIAMLQKEIGVKDLQQRSTIGLLSCNELPSMLYEVIVKDIKGAELENKIAQKIREQYQSIRDFTLNSPQKDNIPTTLIKTISTDTSVTFENQPIDIPRLKNAIQKELALTQEKLLNVKQHEIEVNNYNRNKNTYKFKNQPKDKVDDNKLQRKYVFYRNEIGQEANWLASDLIHFMKNKSLWKGYMHNELQSFLAFFEDKKNDCIALLETVFNLKEDCILTKDLKNLFLKHGNFIDFYKEYLKLKEDFLNTESTFLENGFIGLPPKILKKELSKRLNYIFIVFQKRQFIIKELEEKKNNLYADAINLSRGIFDEKPTMIPFKKPNPDEFASWFVASYQYNNYQSFYELTPDKIENDKKKKYKNLRAINKVKIQDYYLKLMVDTLYQDLFNQPLDKSLSDFYVSKTDREKIKADAKAYQKRNDSFLWNKVIHLSLQNNRITANPKLKDIGKYKRALQDEKIATLLTYDDRTWTYALQKPEKENENDYKELHYTALNMELQEYEKVRSKKLLKQVQELEKQILDKFYDFSNNATHPEDLEIEDKKGKRHPNFKLYITKALLKNESEIINLENIDIEILIKYYDYNTEKLKEKIKNMDEDEKAKIVNTKENYNKITNVLIKKALVLIIIRNKMAHNQYPPKFIYDLATRFVPKKEEEYFACYFNRVFETITTELWENKKKAKEIV

SEQ ID NO: 152 - protein, 1095 aa, Riemerella anatipestifer
MEKPLPPNVYTLKHKFFWGAFLNIARHNAFITICHINEQLGLTTPPNDDKIADVVCGTWNNILNNDHDLLKKSQLTELILKHFPFLAAMCYHPPKKEGKKKGSQKEQQKEKENEAQSQAEALNPSELIKVLKTLVKQLRTLRNYYSHHSHKKPDAEKDIFKHLYKAFDASLRMVKEDYKAHFTVNLTQDFAHLNRKGKNKQDNPDFDRYRFEKDGFFTESGLLFFTNLFLDKRDAYWMLKKVSGFKASHKQSEKMTTEVFCRSRILLPKLRLESRYDHNQMLLDMLSELSRYPKLLYEKLSEEDKKRFQVEADGFLDEIEEEQNPFKDTLIRHQDRFPYFALRYLDLNESFKSIRFQVDLGTYHYCIYDKKIGDEQEKRHLTRTLLSFGRLQDFTEINRPQEWKALTKDLDYKETSKQPFISKTTPHYHITDNKIGFRLGTSKELYPSLEVKDGANRIAQYPYNSDFVAHAFISVHELLPLMFYQHLTGKSEDLLKETVRHIQRIYKDFEEERINTIEDLEKANQGRLPLGAFPKQMLGLLQNKQPDLSEKAKIKIEKLIAETKLLSHRLNTKLKSSPKLGKRREKLIKTGVLADWLVKDFMRFQPVAYDAQNQPIESSKANSTEFQLIQRALALYGGEKNRLEGYFKQTNLIGNTNPHPFLNKFNWKACRNLVDFYQQYLEQREKFLEAIKNQPWEPYQYCLLLKIPKENRKNLVKGWEQGGISLPRGLFTEAIRETLSKDLTLSKPIRKEIKKHGRVGFISRAITLYFREKYQDDHQSFYDLPYKLEAKASPLPKKEHYEYWQQNKPQSPTELQRLELHTSDRWKDYLLYKRWQHLEKKLRLYRNQDVMLWLMTLELTKNHFKELNLNYHQLKLENLAVNVQEADAKLNPLNQTLPMVLPVKVYPATAFGEVQYQETPIRTVYIREEQTKALKMGNFKALVKDRRLNGLFSFIKEENDTQKHPISQLRLRRELEIYQSLRVDAFKETLNLEEKLLKKHTSLSSVENKFRILLEEWKKEYAASSMVTDEHIAFIASVRNAFCHNQYPFYEEALHAPIPLFTVAQQTTEEKDGLGIAEALLRVLREYCEIVKSQI

SEQ ID NO: 153 - protein, 1149 aa, Sinomicrobium oceani
MESTTTLGLHLKYQHDLFEDKHYFGGGVNLAVQNIESIFQAFAERYGIQNPLRKNGVPAINNIFHDNISISNYKEYLKFLKQYLPVVGFLEKSNEINIFEFREDFEILINAIYKLRHFYTHYYHSPIKLEDRFYTCLNELFVAVAIQVKKHKMKSDKTRQLLNKNLHQLLQQLIEQKREKLKDKKAEGEKVSLDTKSIENAVLNDAFVHLLDKDENIRLNYSSRLSEDIITKNGITLSISGLLFLLSLFLQRKEAEDLRSRIEGFKGKGNELRFMATHWVFSYLNVKRIKHRLNTDFQKETLLIQIADELSKVPDEVYKTLDHENRSKFLEDINEYIREGNEDASLNESTVVHGVIRKRYENKFHYLVLRYLDEFVDFPSLRFQVHLGNYIHDRRDKVIDGTNFITNRVIKEPIKVFGKLSHVSKLKSDYMESLSREHKNGWDVFPNPSYNFVGHNIPIFINLRSASSKGKELYRDLMKIKSEKKKKSREEGIPMERRDGKPTKIEISNQIDRNIKDNNFKDIYPGEPLAMLSLNELPALLFELLRRPSITPQDIEDRMVEKLYERFQIIRDYKPGDGLSTSKISKKLRKADNSTRLDGKKLLRAIQTETRNAREKLHTLEENKALQKNRKRRTVYTTREQGREASWLAQDLKRFMPIASRKEWRGYHHSQLQQILAFYDQNPKQPLELLEQFWDLKEDTYVWNSWIHKSLSQHNGFVPMYEGYLKGRLGYYKKLESDIIGFLEEHKVLKRYYTQQHLNVIFRERLYFIKTETKQKLELLARPLVFPRGIFDDKPTFVQDKKVVDHPELFADWYVYSYKDDHSFQEFYHYKRDYNEIFETELSWDIDFKDNKRQLNPSEQMDLFRMKWDLKIKKIKIQDIFLKIVAEDIYLKIFGHKIPLSLSDFYISRQERLTLDEQAVAQSMRLPGDTSENQIKESNLWQTTVPYEKEQIREPKIKLKDIGKFKYFLQQQKVLNLLKYDPQHVWTKAELEEELYIGKHSYEVVRREMLLQKCHQLEKHILEQFRFDGSNHPRELEQGNHPNFKMYIVNGILTKRGELEIEAENWWLELGNSKNSLDKVEVELLTMKTIPEQKAFLLILIRNKFAHNQLPADNYFHYASNLMNLKKSDTYSLFWFTVADTIVQEFMSL

SEQ ID NO: 154 - protein, 1133 aa, Reichenbachiella agariperforans
MKTNPLIASSGEKPNYKKFNTESDKSFKKIFQNKGSIAPIAEKACKNFEIKSKSPVNRDGRLHYFSVGHAFKNIDSKNVFRYELDESQMDMKPTQFLALQKEFFDFQGALNGLLKHIRNVNSHYVHTFEKLEIQSINQKLITFLIEAFELAVIHSYLNEEELSYEAYKDDPQSGQKLVQFLCDKFYPNKEHEVEERKTILAKNKRQALEHLLFIEVTSDIDWKLFEKHKVFTISNGKYLSFHACLFLLSLFLYKSEANQLISKIKGFKRNDDNQYRSKRQIFTFFSKKFTSQDVNSEEQHLVKFRDVIQYLNHYPSAWNKHLELKSGYPQMTDKLMRYIVEAEIYRSFPDQTDNHRFLLFAIREFFGQSCLDTWTGNTPINFSNQEQKGFSYEINTSAEIKDIETKLKALVLKGPLNFKEKKEQNRLEKDLRREKKEQPTNRVKEKLLTRIQHNMLYVSYGRNQDRFMDFAARFLAETDYFGKDAKFKMYQFYTSDEQRDHLKEQKKELPKKEFEKLKYHQSKLVDYFTYAEQQARYPDWDTPFVVENNAIQIKVTLFNGAKKIVSVQRNLMLYLLEDALYSEKRENAGKGLISGYFVHHQKELKDQLDILEKETEISREQKREFKKLLPKRLLHRYSPAQINDTTEWNPMEVILEEAKAQEQRYQLLLEKAILHQTEEDFLKRNKGKQFKLRFVRKAWHLMYLKELYMNKVAEHGHHKSFHITKEEFNDFCRWMFAFDEVPKYKEYLCDYFSQKGFFNNAEFKDLIESSTSLNDLYEKTKQRFEGWSKDLTKQSDENKYLLANYESMLKDDMLYVNISHFISYLESKGKINRNAHGHIAYKALNNVPHLIEEYYYKDRLAPEEYKSHGKLYNKLKTVKLEDALLYEMAMHYLSLEPALVPKVKTKVKDILSSNIAFDIKDAAGHHLYHLLIPFHKIDSFVALINHQSQQEKDPDKTSFLAKIQPYLEKVKNSKDLKAVYHYYKDTPHTLRYEDLNMIHSHIVSQSVQFTKVALKLEEYFIAKKSITLQIARQISYSEIADLSNYFTDEVRNTAFHFDVPETAYSMILQGIESEFLDREIKPQKPKSLSELSTQQVSVCTAFLETLHNNLFDRKDDKKERLSKARERYFEQIN

SEQ ID NO: 155 - protein, 1115 aa, Fusobacterium necrophorum subsp. funduliforme
MEKFRRQNRNSIIKIIISNYDTKGIKELKVRYRKQAQLDTFIIKTEIVNNDIFIKSIIEKAREKYRYSFLFDGEEKYHFKNKSSVEIVKKDIFSQTPDNMIRNYKITLKISEKNPRVVEAEIEDLMNSTILKDGRRSARREKSMTERKLIEEKVAKNYSLLANCPMEEVDSIKIYKIKRFLTYRSNMLLYFASINSFLCEGIKGKDNETEEIWHLKDNDVRKEKVRENFKNKLIQSTENYNSSLKNQIEEKEKLLRKEFKKGAFYRTIIKKLQQERIKELSEKSLTEDCEKIIKLYSKLRHSLMHYDYQYFENLFENKKNDDLMKDLNLDLFKSLPLIRKMKLNNKVNYLEDGDTLFVLQKTKKAKTLYQIYDALCEQKNGFNKFINDFFVSDGEENTVFKQIINEKFQSEMEFLEKRISESEKKNEKLKKKLDSMKAHFRNINSEDTKEAYFWDIHSSRNYKTKYNERKNLVNEYTELLGSSKEKKLLREEITKINRQLLKLKQEMEEITKKNSLFRLEYKMKIAFGFLFCEFDGNISKFKDEFDASNQEKIIQYHKNGEKYLTSFLKEEEKEKFNLEKMQKIIQKTEEEDWLLPETKNNLFKFYLLTYLLLPYELKGDFLGFVKKHYYDIKNVDFIDENQNNIQVSQTVEKQEDYFYHKIRLFEKNTKKYEIVKYSIVPNEKLKQYFEDLGIDIKYLTVEQKSEVSEEKNKKVSLKNNGMFNKTILLFVFKYYQIAFKLFNDIELYSLFFLREKSGKPLEIFRKELESKMKDGYLNFGQLLYVVYEVLVKNKDLDKILSKKIDYRKDKSFSPEIAYLRNFLSHLNYSKFLDNFMKINTNKSDENKEVLIPSIKIQKMIQFIEKCNLQNQIDFDFNFVNDFYMRKEKMFFIQLKQIFPDINSTEKQKMNEKEEILRNRYHLTDKKNEQIKDEHEAQSQLYEKILSLQKIYSSDKNNFYGRLKEEKLLFLEKQGKKKLSMEEIKDKIAGDISDLLGILKKEITRDIKDKLTEKFRYCEEKLLNLSFYNHQDKKKEESIRVFLIRDKNSDNFKFESILDDGSNKIFISKNGKEITIQCCDKVLETLIIEKNTLKISSNGKIISLIPHYSYSIDVKY

SEQ ID NO: 156 - protein, 1111 aa, Fusobacterium necrophorum
MEKFRRQNRSSIIKIIISNYDTKGIKELKVRYRKQAQLDTFIIKTEIVNNDIFIKSIIEKAREKYRYSFLFDGEEKYHFKNKSSVEIVKKDIFSQTPDNMIRNYKITLKISEKNPRVVEAEIEDLMNSTILKDGRRSARREKSMTERKLIEEKVAENYSLLANCPMEEVDSIKIYKIKRFLTYRSNMLLYFASINSFLCEGIKGKDNETEEIWHLKDNDVRKEKVKENFKNKLIQSTENYNSSLKNQIEEKEKLLRKESKKGAFYRTIIKKLQQERIKELSEKSLTEDCEKIIKLYSELRHPLMHYDYQYFENLFENKENSELTKNLNLDIFKSLPLVRKMKLNNKVNYLEDNDTLFVLQKTKKAKTLYQIYDALCEQKNGFNKFINDFFVSDGEENTVFKQIINEKFQSEIEFLEKRISESEKKNEKLKKKLDSMKAHFRNINSEDTKEAYFWDIHSSRNYKTKYNERKNLVNEYTELLGSSKEKKLLREEITKINRQLLKLKQEMEEITKKNSLFRLEYKMKMAFGFLFCEFDGNISRFKDEFDASNQEKIIQYHKNGEKYLTYFLKEEEKEKFNLKKLQETIQKTGEENWLLPQNKNNLFKFYLLTYLLLPYELKGDFLGFVKKHYYDIKNVDFMDENQSSKIIESKEDDFYHKIRLFEKNTKKYEIVKYSIVPDKKLKQYFKDLGIDTKYLILDQKSEVSGEKNKKVSLKNNGMFNKTILLFVFKYYQIAFKLFNDIELYSLFFLREKSGKPFEVFLKELKDKMIGKQLNFGQLLYVVYEVLVKNKDLSEILSERIDYRKDMCFSAEIADLRNFLSHLNYSKFLDNFMKINTNKSDENKEVLIPSIKIQKMIKFIEECNLQSQIDFDFNFVNDFYMRKEKMFFIQLKQIFPDINSTEKQKMNEKEEILRNRYHLTDKKNEQIKDEHEAQSQLYEKILSLQKIYSSDKNNFYGRLKEEKLLFLEKQEKKKLSMEEIKDKIAGDISDLLGILKKEITRDIKDKLTEKFRYCEEKLLNLSFYNHQDKKKEESIRVFLIRDKNSDNFKFESILDDGSNKIFISKNGKEITIQCCDKVLETLIIEKNTLKISSNGKIISLIPHYSYSIDVKY

SEQ ID NO: 157 - protein, 1110 aa, Fusobacterium necrophorum
MKVRYRKQAQLDTFIIKTEIVNNDIFIKSIIEKAREKYRYSFLFDGEEKYHFKNKSSVEIVKNDIFSQTPDNMIRNYKITLKISEKNPRVVEAEIEDLMNSTILKDGRRSARREKSMTERKLIEEKVAENYSLLANCPIEEVDSIKIYKIKRFLTYRSNMLLYFASINSFLCEGIKGKDNETEEIWHLKDNDVRKEKVKENFKNKLIQSTENYNSSLKNQIEEKEKLSSKEFKKGAFYRTIIKKLQQERIKELSEKSLTEDCEKIIKLYSELRHPLMHYDYQYFENLFENKENSELTKNLNLDIFKSLPLVRKMKLNNKVNYLEDNDTLFVLQKTKKAKTLYQIYDALCEQKNGFNKFINDFFVSDGEENTVFKQIINEKFQSEMEFLEKRISESEKKNEKLKKKLDSMKAHFRNINSEDTKEAYFWDIHSSRNYKTKYNERKNLVNEYTKLLGSSKEKKLLREEITKINRQLLKLKQEMEEITKKNSLFRLEYKMKIAFGFLFCEFDGNISKFKDEFDASNQEKIIQYHKNGEKYLTSFLKEEEKEKFNLEKMQKIIQKTEEEDWLLPETKNNLFKFYLLTYLLLPYELKGDFLGFVKKHYYDIKNVDFMDENQNNIQVSQTVEKQEDYFYHKIRLFEKNTKKYEIVKYSIVPNEKLKQYFEDLGIDIKYLTGSVESGEKWLGENLGIDIKYLTVEQKSEVSEEKNKKVSLKNNGMFNKTILLFVFKYYQIAFKLFNDIELYSLFFLREKSEKPFEVFLEELKDKMIGKQLNFGQLLYVVYEVLVKNKDLDKILSKKIDYRKDKSFSPEIAYLRNFLSHLNYSKFLDNFMKINTNKSDENKEVLIPSIKIQKMIQFIEKCNLQNQIDFDFNFVNDFYMRKEKMFFIQLKQIFPDINSTEKQKKSEKEEILRKRYHLINKKNEQIKDEHEAQSQLYEKILSLQKIFSCDKNNFYRRLKEEKLLFLEKQGKKKISMKEIKDKIASDISDLLGILKKEITRDIKDKLTEKFRYCEEKLLNISFYNHQDKKKEEGIRVFLIRDKNSDNFKFESILDDGSNKIFISKNGKEITIQCCDKVLETLMIEKNTLKISSNGKIISLIPHYSYSIDVKY

SEQ ID NO: 158 - protein, 668 aa, Fusobacterium necrophorum subsp. funduliforme
MTEKKSIIFKNKSSVEIVKKDIFSQTPDNMIRNYKITLKISEKNPRVVEAEIEDLMNSTILKDGRRSARREKSMTERKLIEEKVAENYSLLANCPMEEVDSIKIYKIKRFLTYRSNMLLYFASINSFLCEGIKGKDNETEEIWHLKDNDVRKEKVKENFKNKLIQSTENYNSSLKNQIEEKEKLLRKESKKGAFYRTIIKKLQQERIKELSEKSLTEDCEKIIKLYSELRHPLMHYDYQYFENLFENKENSELTKNLNLDIFKSLPLVRKMKLNNKVNYLEDNDTLFVLQKTKKAKTLYQIYDALCEQKNGFNKFINDFFVSDGEENTVFKQIINEKFQSEMEFLEKRISESEKKNEKLKKKFDSMKAHFHNINSEDTKEAYFWDIHSSSNYKTKYNERKNLVNEYTELLGSSKEKKLLREEITQINRKLLKLKQEMEEITKKNSLFRLEYKMKIAFGFLFCEFDGNISKFKDEFDASNQEKIIQYHKNGEKYLTYFLKEEEKEKFNLEKMQKIIQKTEEEDWLLPETKNNLFKFYLLTYLLLPYELKGDFLGFVKKHYYDIKNVDFMDENQNNIQVSQTVEKQEDYFYHKIRLFEKNTKKYEIVKYSIVPNEKLKQYFEDLGIDIKYLTGSVESGEKWLGENLGIDIKYLTVEQKSEVSEEKIKKFL

SEQ ID NO: 159 - protein, 1121 aa, Fusobacterium perfoetens
MGKPNRSSIIKIIISNYDNKGIKEVKVRYNKQAQLDTFLIKSELKDGKFILYSIVDKAREKYRYSFEIDKTNINKNEILIIKKDIYSNKEDKVIRKYILSFEVSEKNDRTIVTKIKDCLETQKKEKFERENTRRLISETERKLLSEETQKTYSKIACCSPEDIDSVKIYKIKRYLAYRSNMLLFFSLINDIFVKGVVKDNGEEVGEIWRIIDSKEIDEKKTYDLLVENFKKRMSQEFINYKQSIENKIEKNTNKIKEIEQKLKKEKYKKEINRLKKQLIELNRENDLLEKDKIELSDEEIREDIEKILKIYSDLRHKLMHYNYQYFENLFENKKISKEKNEDVNLTELLDLNLFRYLPLVRQLKLENKTNYLEKEDKITVLGVSDSAIKYYSYYNFLCEQKNGFNNFINSFFSNDGEENKSFKEKINLSLEKEIEIMEKETNEKIKEINKNELQLMKEQKELGTAYVLDIHSLNDYKISHNERNKNVKLQNDIMNGNRDKNALDKINKKLVELKIKMDKITKRNSILRLKYKLQVAYGFLMEEYKGNIKKFKDEFDISKEKIKSYKSKGEKYLEVKSEKKYITKILNSIEDIHNITWLKNQEENNLFKFYVLTYILLPFEFRGDFLGFVKKHYYDIKNVEFLDENNDRLTPEQLEKMKNDSFFNKIRLFEKNSKKYDILKESILTSERIGKYFSLLNTGAKYFEYGGEENRGIFNKNIIIPIFKYYQIVLKLYNDVELAMLLTLSESDEKDINKIKELVTLKEKVSPKKIDYEKKYKFSVLLDCFNRIINLGKKDFLASEEVKEVAKTFTNLAYLRNKICHLNYSKFIDDLLTIDTNKSTTDSEGKLLINDRIRKLIKFIRENNQKMNISIDYNYINDYYMKKEKFIFGQRKQAKTIIDSGKKANKRNKAEELLKMYRVKKENINLIYELSKKLNELTKSELFLLDKKLLKDIDFTDVKIKNKSFFELKNDVKEVANIKQALQKHSSELIGIYKKEVIMAIKRSIVSKLIYDEEKVLSIIIYDKTNKKYEDFLLEIRRERDINKFQFLIDEKKEKLGYEKIIETKEKKKVVVKIQNNSELVSEPRIIKNKDKKKAKTPEEISKLGILDLTNHYCFNLKITL

SEQ ID NO: 160 - protein, 897 aa, Fusobacterium ulcerans
MENKGNNKKIDFDENYNILVAQIKEYFTKEIENYNNRIDNIIDKKELLKYSEKKEESEKNKKLEELNKLKSQKLKILTDEEIKADVIKIIKIFSDLRHSLMHYEYKYFENLFENKKNEELAELLNLNLFKNLTLLRQMKIENKTNYLEGREEFNIIGKNIKAKEVLGHYNLLAEQKNGFNNFINSFFVQDGTENLEFKKLIDEHFVNAKKRLERNIKKSKKLEKELEKMEQHYQRLNCAYVWDIHTSTTYKKLYNKRKSLIEEYNKQINEIKDKEVITAINVELLRIKKEMEEITKSNSLFRLKYKMQIAYAFLEIEFGGNIAKFKDEFDCSKMEEVQKYLKKGVKYLKYYKDKEAQKNYEFPFEEIFENKDTHNEEWLENTSENNLFKFYILTYLLLPMEFKGDFLGVVKKHYYDIKNVDFTDESEKELSQVQLDKMIGDSFFHKIRLFEKNTKRYEIIKYSILTSDEIKRYFRLLELDVPYFEYEKGTDEIGIFNKNIILTIFKYYQIIFRLYNDLEIHGLFNISSDLDKILRDLKSYGNKNINFREFLYVIKQNNNSSTEEEYRKIWENLEAKYLRLHLLTPEKEEIKTKTKEELEKLNEISNLRNGICHLNYKEIIEEILKTEISEKNKEATLNEKIRKVINFIKENELDKVELGFNFINDFFMKKEQFMFGQIKQVKEGNSDSITTERERKEKNNKKLKETYELNCDNLSEFYETSNNLRERANSSSLLEDSAFLKKIGLYKVKNNKVNSKVKDEEKRIENIKRKLLKDSSDIMGMYKAEVVKKLKEKLILIFKHDEEKRIYVTVYDTSKAVPENISKEILVKRNNSKEEYFFEDNNKKYVTEYYTLEITETNELKVIPAKKLEGKEFKTEKNKENKLMLNNHYCFNVKIIY

SEQ ID NO: 161 - protein, 1111 aa, Anaerosalibacter species
MKSGRREKAKSNKSSIVRVIISNFDDKQVKEIKVLYTKQGGIDVIKFKSTEKDEKGRMKFNFDCAYNRLEEEEFNSFGGKGKQSFFVTTNEDLTELHVTKRHKTTGEIIKDYTIQGKYTPIKQDRTKVTVSITDNKDHFDSNDLGDKIRLSRSLTQYTNRILLDADVMKNYREIVCSDSEKVDETINIDSQEIYKINRFLSYRSNMIIYYQMINNFLLHYDGEEDKGGNDSINLINEIWKYENKKNDEKEKIIERSYKSIEKSINQYILNHNTEVESGDKEKKIDISEERIKEDLKKTFILFSRLRHYMVHYNYKFYENLYSGKNFIIYNKDKSKSRRFSELLDLNIFKELSKIKLVKNRAVSNYLDKKTTIHVLNKNINAIKLLDIYRDICETKNGFNNFINNMMTISGEEDKEYKEMVTKHFNENMNKLSIYLENFKKHSDFKTNNKKKETYNLLKQELDEQKKLRLWFNAPYVYDIHSSKKYKELYVERKKYVDIHSKLIEAGINNDNKKKLNEINVKLCELNTEMKEMTKLNSKYRLQYKLQLAFGFILEEFNLDIDKFVSAFDKDNNLTISKFMEKRETYLSKSLDRRDNRFKKLIKDYKFRDTEDIFCSDRENNLVKLYILMYILLPVEIRGDFLGFVKKNYYDLKHVDFIDKRNNDNKDTFFHDLRLFEKNVKRLEVTSYSLSDGFLGKKSREKFGKELEKFIYKNVSIALPTNIDIKEFNKSLVLPMMKNYQIIFKLLNDIEISALFLIAKKEGNEGSITFKKVIDKVRKEDMNGNINFSQVMKMALNEKVNCQIRNSIAHINMKQLYIEPLNIYINNNQNKKTISEQMEEIIDICITKGLTGKELNKNIINDYYMKKEKLVFNLKLRKRNNLVSIDAQQKNMKEKSILNKYDLNYKDENLNIKEIILKVNDLNNKQKLLKETTEGESNYKNALSKDILLLNGIIRKNINFKIKEMILGIIQQNEYRYVNINIYDKIRKEDHNIDLKINNKYIEISCYENKSNESTDERINFKIKYMDLKVKNELLVPSCYEDIYIKKKIDLEIRYIENCKVVYIDIYYKKYNINLEFDGKTLFVKFNKDVKKNNQKVNLESNYIQNIKFIVS

SEQ ID NO: 162 - DNA, 45 bp, Artificial
  Synthetic Oligonucleotide
catagaatgttctaaaccatcctgcggcctctactctgcattcaa

SEQ ID NO: 163 - DNA, 45 bp, Artificial
  Synthetic Oligonucleotide
catagaatgttcgaaaccatcctgcggcctctactctgcattcaa

SEQ ID NO: 164 - DNA, 45 bp, Artificial
  Synthetic Oligonucleotide
catagaatggtcgaaaccatcctgcggcctctactctgcattcaa

SEQ ID NO: 165 - DNA, 45 bp, Artificial
  Synthetic Oligonucleotide
catagaatgttcaaaaccatcctgcggcctctactctgcattcaa

SEQ ID NO: 166 - DNA, 45 bp, Artificial
  Synthetic Oligonucleotide
catagaatgatcaaaaccatcctgcggcctctactctgcattcaa

SEQ ID NO: 167 - DNA, 46 bp, Artificial
  Synthetic Oligonucleotide
ggtttctccatcaattaccacttgcttcctgtaggaatcctctatt

SEQ ID NO: 168 - DNA, 46 bp, Artificial
  Synthetic Oligonucleotide
ggtttctccatcaatgaccacttgcttcctgtaggaatcctctatt

SEQ ID NO: 169 - DNA, 46 bp, Artificial
  Synthetic Oligonucleotide
ggtttctccatcaaggaccacttgcttcctgtaggaatcctctatt

SEQ ID NO: 170 - DNA, 46 bp, Artificial
  Synthetic Oligonucleotide
ggtttctccatcaataaccacttgcttcctgtaggaatcctctatt

SEQ ID NO: 171 - DNA, 46 bp, Artificial
  Synthetic Oligonucleotide
ggtttctccatcaaaaaccacttgcttcctgtaggaatcctctatt

SEQ ID NO: 172 - DNA, 46 bp, Artificial
  Synthetic Oligonucleotide
gcctttctctcctgtagccaaggccacaaaattatccactgttttt

SEQ ID NO: 173 - protein, 46 aa, Artificial
  Synthetic Oligonucleotide
GCCTTTCTCTCCTGGAGCCAAGGCCACAAAATTATCCACTGTTTTT

SEQ ID NO: 174 - DNA, 46 bp, Artificial
  Synthetic Oligonucleotide
gcctttctctcctgaagccaaggccacaaaattatccactgttttt

SEQ ID NO: 175 - DNA, 46 bp, Artificial
  Synthetic Oligonucleotide
gcatagaatgttctaaaccatcctgcggcctctactctgcattcaa

SEQ ID NO: 176 - DNA, 46 bp, Artificial
  Synthetic Oligonucleotide
gcatagaatgttctaaacgatcctgcggcctctactctgcattcaa

SEQ ID NO: 177 - DNA, 46 bp, Artificial
  Synthetic Oligonucleotide
gcatagaatgttctaaactatcctgcggcctctactctgcattcaa

SEQ ID NO: 178 - protein, 46 aa, Artificial
  Synthetic Oligonucleotide
GCATAGAATGTTCTAAACAATCCTGCGGCCTCTACTCTGCATTCAA

SEQ ID NO: 179 - DNA, 31 bp, Artificial
  Synthetic Oligonucleotide
gcatcctgcggcctctactctgcattcaatt

SEQ ID NO: 180 - DNA, 31 bp, Artificial
  Synthetic Oligonucleotide
gaccatcctgcggcctctactctgcattcaa

SEQ ID NO: 181 - DNA, 31 bp, Artificial
  Synthetic Oligonucleotide
gaaaccatcctgcggcctctactctgcattc

SEQ ID NO: 182 - DNA, 31 bp, Artificial
  Synthetic Oligonucleotide
gctaaaccatcctgcggcctctactctgcat

SEQ ID NO: 183 - DNA, 31 bp, Artificial
  Synthetic Oligonucleotide
gttctaaaccatcctgcggcctctactctgc

SEQ ID NO: 184 - DNA, 31 bp, Artificial
  Synthetic Oligonucleotide
gtgttctaaaccatcctgcggcctctactct

SEQ ID NO: 185 - DNA, 31 bp, Artificial
  Synthetic Oligonucleotide
gaatgttctaaaccatcctgcggcctctact

SEQ ID NO: 186 - DNA, 31 bp, Artificial
  Synthetic Oligonucleotide
gagaatgttctaaaccatcctgcggcctcta

SEQ ID NO: 187 - DNA, 31 bp, Artificial
  Synthetic Oligonucleotide
gatagaatgttctaaaccatcctgcggcctc

SEQ ID NO: 188 - DNA, 31 bp, Artificial
  Synthetic Oligonucleotide
gccatagaatgttctaaaccatcctgcggcc

SEQ ID NO: 189 - DNA, 31 bp, Artificial
  Synthetic Oligonucleotide
gttccatagaatgttctaaaccatcctgcgg

SEQ ID NO: 190 - DNA, 31 bp, Artificial
  Synthetic Oligonucleotide
gctttccatagaatgttctaaaccatcctgc

SEQ ID NO: 191 - DNA, 31 bp, Artificial
  Synthetic Oligonucleotide
gctctttccatagaatgttctaaaccatcct

SEQ ID NO: 192 - DNA, 31 bp, Artificial
  Synthetic Oligonucleotide
gatctctttccatagaatgttctaaaccatc

SEQ ID NO: 193 - DNA, 31 bp, Artificial
  Synthetic Oligonucleotide
ggaatctctttccatagaatgttctaaacca

SEQ ID NO: 194 - DNA, 51 bp, Artificial
  Synthetic Oligonucleotide
gcatcctgcggcctctactctgcattcaattacatactgacacattcggca

SEQ ID NO: 195 - DNA, 51 bp, Artificial
  Synthetic Oligonucleotide
gaccatcctgcggcctctactctgcattcaattacatactgacacattcgg

SEQ ID NO: 196 - DNA, 51 bp, Artificial
  Synthetic Oligonucleotide
gaaaccatcctgcggcctctactctgcattcaattacatactgacacattc

SEQ ID NO: 197 - DNA, 51 bp, Artificial
  Synthetic Oligonucleotide
gctaaaccatcctgcggcctctactctgcattcaattacatactgacacat

SEQ ID NO: 198 - DNA, 51 bp, Artificial
  Synthetic Oligonucleotide
gttctaaaccatcctgcggcctctactctgcattcaattacatactgacac

SEQ ID NO: 199 - DNA, 51 bp, Artificial
  Synthetic Oligonucleotide
gtgttctaaaccatcctgcggcctctactctgcattcaattacatactgac

SEQ ID NO: 200 - DNA, 51 bp, Artificial
  Synthetic Oligonucleotide
gaatgttctaaaccatcctgcggcctctactctgcattcaattacatactg

SEQ ID NO: 201 - DNA, 51 bp, Artificial
  Synthetic Oligonucleotide
gagaatgttctaaaccatcctgcggcctctactctgcattcaattacatac

SEQ ID NO: 202 - DNA, 51 bp, Artificial
  Synthetic Oligonucleotide
gatagaatgttctaaaccatcctgcggcctctactctgcattcaattacat

SEQ ID NO: 203 - DNA, 51 bp, Artificial
  Synthetic Oligonucleotide
gccatagaatgttctaaaccatcctgcggcctctactctgcattcaattac

SEQ ID NO: 204 - DNA, 51 bp, Artificial
  Synthetic Oligonucleotide
gttccatagaatgttctaaaccatcctgcggcctctactctgcattcaatt

SEQ ID NO: 205 - DNA, 51 bp, Artificial
  Synthetic Oligonucleotide
gctttccatagaatgttctaaaccatcctgcggcctctactctgcattcaa

SEQ ID NO: 206 - DNA, 51 bp, Artificial
  Synthetic Oligonucleotide
gctctttccatagaatgttctaaaccatcctgcggcctctactctgcattc

SEQ ID NO: 207 - DNA, 51 bp, Artificial
  Synthetic Oligonucleotide
gatctctttccatagaatgttctaaaccatcctgcggcctctactctgcat

SEQ ID NO: 208 - DNA, 51 bp, Artificial
  Synthetic Oligonucleotide
ggaatctctttccatagaatgttctaaaccatcctgcggcctctactctgc

SEQ ID NO: 209 - DNA, 51 bp, Artificial
  Synthetic Oligonucleotide
gtggaatctctttccatagaatgttctaaaccatcctgcggcctctactct

SEQ ID NO: 210 - DNA, 51 bp, Artificial
  Synthetic Oligonucleotide
gactggaatctctttccatagaatgttctaaaccatcctgcggcctctact

SEQ ID NO: 211 - DNA, 51 bp, Artificial
  Synthetic Oligonucleotide
ggaactggaatctctttccatagaatgttctaaaccatcctgcggcctcta

SEQ ID NO: 212 - DNA, 51 bp, Artificial
  Synthetic Oligonucleotide
gtggaactggaatctctttccatagaatgttctaaaccatcctgcggcctc

SEQ ID NO: 213 - DNA, 51 bp, Artificial
  Synthetic Oligonucleotide
gcctggaactggaatctctttccatagaatgttctaaaccatcctgcggcc

SEQ ID NO: 214 - DNA, 51 bp, Artificial
  Synthetic Oligonucleotide
gttcctggaactggaatctctttccatagaatgttctaaaccatcctgcgg

SEQ ID NO: 215 - DNA, 51 bp, Artificial
  Synthetic Oligonucleotide
gggttcctggaactggaatctctttccatagaatgttctaaaccatcctgc

SEQ ID NO: 216 - DNA, 51 bp, Artificial
  Synthetic Oligonucleotide
gcaggttcctggaactggaatctctttccatagaatgttctaaaccatcct

SEQ ID NO: 217 - DNA, 51 bp, Artificial
  Synthetic Oligonucleotide
gaccaggttcctggaactggaatctctttccatagaatgttctaaaccatc

SEQ ID NO: 218 - DNA, 51 bp, Artificial
  Synthetic Oligonucleotide
ggtaccaggttcctggaactggaatctctttccatagaatgttctaaacca

SEQ ID NO: 219 - DNA, 71 bp, Artificial
  Synthetic Oligonucleotide
gcatcctgcggcctctactctgcattcaattacatactgacacattcggcaacatgtttttcctggtttat

SEQ ID NO: 220 - DNA, 71 bp, Artificial
  Synthetic Oligonucleotide
gaccatcctgcggcctctactctgcattcaattacatactgacacattcggcaacatgtttttcctggttt

SEQ ID NO: 221 - DNA, 71 bp, Artificial
  Synthetic Oligonucleotide
gaaaccatcctgcggcctctactctgcattcaattacatactgacacattcggcaacatgtttttcctggt

SEQ ID NO: 222 - DNA, 71 bp, Artificial
  Synthetic Oligonucleotide
gctaaaccatcctgcggcctctactctgcattcaattacatactgacacattcggcaacatgtttttcctg

SEQ ID NO: 223 - DNA, 71 bp, Artificial
  Synthetic Oligonucleotide
gttctaaaccatcctgcggcctctactctgcattcaattacatactgacacattcggcaacatgtttttcc

SEQ ID NO: 224 - DNA, 71 bp, Artificial
  Synthetic Oligonucleotide
gtgttctaaaccatcctgcggcctctactctgcattcaattacatactgacacattcggcaacatgttttt

SEQ ID NO: 225 - DNA, 71 bp, Artificial
  Synthetic Oligonucleotide
gaatgttctaaaccatcctgcggcctctactctgcattcaattacatactgacacattcggcaacatgttt

SEQ ID NO: 226 - DNA, 71 bp, Artificial
  Synthetic Oligonucleotide
gagaatgttctaaaccatcctgcggcctctactctgcattcaattacatactgacacattcggcaacatgt

SEQ ID NO: 227 - DNA, 71 bp, Artificial
  Synthetic Oligonucleotide
gatagaatgttctaaaccatcctgcggcctctactctgcattcaattacatactgacacattcggcaacat

SEQ ID NO: 228 - DNA, 71 bp, Artificial
  Synthetic Oligonucleotide
gccatagaatgttctaaaccatcctgcggcctctactctgcattcaattacatactgacacattcggcaac

SEQ ID NO: 229 - DNA, 71 bp, Artificial
  Synthetic Oligonucleotide
gttccatagaatgttctaaaccatcctgcggcctctactctgcattcaattacatactgacacattcggca

SEQ ID NO: 230 - DNA, 71 bp, Artificial
  Synthetic Oligonucleotide
gctttccatagaatgttctaaaccatcctgcggcctctactctgcattcaattacatactgacacattcgg

SEQ ID NO: 231 - DNA, 71 bp, Artificial
  Synthetic Oligonucleotide
gctctttccatagaatgttctaaaccatcctgcggcctctactctgcattcaattacatactgacacattc

SEQ ID NO: 232 - DNA, 71 bp, Artificial
  Synthetic Oligonucleotide
gatctctttccatagaatgttctaaaccatcctgcggcctctactctgcattcaattacatactgacacat

SEQ ID NO: 233 - DNA, 71 bp, Artificial
  Synthetic Oligonucleotide
ggaatctctttccatagaatgttctaaaccatcctgcggcctctactctgcattcaattacatactgacac

SEQ ID NO: 234 - DNA, 71 bp, Artificial
  Synthetic Oligonucleotide
gtggaatctctttccatagaatgttctaaaccatcctgcggcctctactctgcattcaattacatactgac

SEQ ID NO: 235 - DNA, 71 bp, Artificial
  Synthetic Oligonucleotide
gactggaatctctttccatagaatgttctaaaccatcctgcggcctctactctgcattcaattacatactg

SEQ ID NO: 236 - DNA, 71 bp, Artificial
  Synthetic Oligonucleotide
ggaactggaatctctttccatagaatgttctaaaccatcctgcggcctctactctgcattcaattacatac

SEQ ID NO: 237 - DNA, 71 bp, Artificial
  Synthetic Oligonucleotide
gtggaactggaatctctttccatagaatgttctaaaccatcctgcggcctctactctgcattcaattacat

SEQ ID NO: 238 - DNA, 71 bp, Artificial
  Synthetic Oligonucleotide
gcctggaactggaatctctttccatagaatgttctaaaccatcctgcggcctctactctgcattcaattac

SEQ ID NO: 239 - DNA, 71 bp, Artificial
  Synthetic Oligonucleotide
gttcctggaactggaatctctttccatagaatgttctaaaccatcctgcggcctctactctgcattcaatt

SEQ ID NO: 240 - DNA, 71 bp, Artificial
  Synthetic Oligonucleotide
gggttcctggaactggaatctctttccatagaatgttctaaaccatcctgcggcctctactctgcattcaa

SEQ ID NO: 241 - DNA, 71 bp, Artificial
  Synthetic Oligonucleotide
gcaggttcctggaactggaatctctttccatagaatgttctaaaccatcctgcggcctctactctgcattc

SEQ ID NO: 242 - DNA, 71 bp, Artificial
  Synthetic Oligonucleotide
gaccaggttcctggaactggaatctctttccatagaatgttctaaaccatcctgcggcctctactctgcat

SEQ ID NO: 243 - DNA, 71 bp, Artificial
  Synthetic Oligonucleotide
ggtaccaggttcctggaactggaatctctttccatagaatgttctaaaccatcctgcggcctctactctgc

SEQ ID NO: 244 - DNA, 71 bp, Artificial
  Synthetic Oligonucleotide
gatgtaccaggttcctggaactggaatctctttccatagaatgttctaaaccatcctgcggcctctactct

SEQ ID NO: 245 - DNA, 71 bp, Artificial
  Synthetic Oligonucleotide
ggtatgtaccaggttcctggaactggaatctctttccatagaatgttctaaaccatcctgcggcctctact

SEQ ID NO: 246 - DNA, 71 bp, Artificial
  Synthetic Oligonucleotide
gacgtatgtaccaggttcctggaactggaatctctttccatagaatgttctaaaccatcctgcggcctcta

SEQ ID NO: 247 - DNA, 71 bp, Artificial
  Synthetic Oligonucleotide
gacacgtatgtaccaggttcctggaactggaatctctttccatagaatgttctaaaccatcctgcggcctc

SEQ ID NO: 248 - DNA, 71 bp, Artificial
  Synthetic Oligonucleotide
gcaacacgtatgtaccaggttcctggaactggaatctctttccatagaatgttctaaaccatcctgcggcc

SEQ ID NO: 249 - DNA, 71 bp, Artificial
  Synthetic Oligonucleotide
gcccaacacgtatgtaccaggttcctggaactggaatctctttccatagaatgttctaaaccatcctgcgg

SEQ ID NO: 250 - DNA, 71 bp, Artificial
  Synthetic Oligonucleotide
ggacccaacacgtatgtaccaggttcctggaactggaatctctttccatagaatgttctaaaccatcctgc

SEQ ID NO: 251 - DNA, 71 bp, Artificial
  Synthetic Oligonucleotide
gttgacccaacacgtatgtaccaggttcctggaactggaatctctttccatagaatgttctaaaccatcct

SEQ ID NO: 252 - DNA, 71 bp, Artificial
  Synthetic Oligonucleotide
gccttgacccaacacgtatgtaccaggttcctggaactggaatctctttccatagaatgttctaaaccatc

SEQ ID NO: 253 - DNA, 71 bp, Artificial
  Synthetic Oligonucleotide
gttccttgacccaacacgtatgtaccaggttcctggaactggaatctctttccatagaatgttctaaacca

SEQ ID NO: 254 - DNA, 85 bp, Artificial
  Synthetic Oligonucleotide
gcatcctgcggcctctactctgcattcaattacatactgacacattcggcaacatgtttttcctggtttattttcacacagtcca

SEQ ID NO: 255 - DNA, 85 bp, Artificial
  Synthetic Oligonucleotide
gaccatcctgcggcctctactctgcattcaattacatactgacacattcggcaacatgtttttcctggtttattttcacacagtc

SEQ ID NO: 256 - DNA, 85 bp, Artificial
  Synthetic Oligonucleotide
gaaaccatcctgcggcctctactctgcattcaattacatactgacacattcggcaacatgtttttcctggtttattttcacacag

SEQ ID NO: 257 - DNA, 85 bp, Artificial
  Synthetic Oligonucleotide
gctaaaccatcctgcggcctctactctgcattcaattacatactgacacattcggcaacatgtttttcctggtttattttcacac

SEQ ID NO: 258 - DNA, 85 bp, Artificial
  Synthetic Oligonucleotide
gttctaaaccatcctgcggcctctactctgcattcaattacatactgacacattcggcaacatgtttttcctggtttattttcac

SEQ ID NO: 259 - DNA, 85 bp, Artificial
  Synthetic Oligonucleotide
gtgttctaaaccatcctgcggcctctactctgcattcaattacatactgacacattcggcaacatgtttttcctggtttattttc

SEQ ID NO: 260 - DNA, 85 bp, Artificial
  Synthetic Oligonucleotide
gaatgttctaaaccatcctgcggcctctactctgcattcaattacatactgacacattcggcaacatgtttttcctggtttattt

SEQ ID NO: 261 - DNA, 85 bp, Artificial
  Synthetic Oligonucleotide
gagaatgttctaaaccatcctgcggcctctactctgcattcaattacatactgacacattcggcaacatgtttttcctggtttat

SEQ ID NO: 262 - DNA, 85 bp, Artificial
  Synthetic Oligonucleotide
gatagaatgttctaaaccatcctgcggcctctactctgcattcaattacatactgacacattcggcaacatgtttttcctggttt

SEQ ID NO: 263 - DNA, 85 bp, Artificial
  Synthetic Oligonucleotide
gccatagaatgttctaaaccatcctgcggcctctactctgcattcaattacatactgacacattcggcaacatgtttttcctggt

SEQ ID NO: 264 - DNA, 85 bp, Artificial
  Synthetic Oligonucleotide
gttccatagaatgttctaaaccatcctgcggcctctactctgcattcaattacatactgacacattcggcaacatgtttttcctg

SEQ ID NO: 265 - DNA, 85 bp, Artificial
  Synthetic Oligonucleotide
gctttccatagaatgttctaaaccatcctgcggcctctactctgcattcaattacatactgacacattcggcaacatgtttttcc

SEQ ID NO: 266 - DNA, 85 bp, Artificial
  Synthetic Oligonucleotide
gctctttccatagaatgttctaaaccatcctgcggcctctactctgcattcaattacatactgacacattcggcaacatgttttt

SEQ ID NO: 267 - DNA, 85 bp, Artificial
  Synthetic Oligonucleotide
gatctctttccatagaatgttctaaaccatcctgcggcctctactctgcattcaattacatactgacacattcggcaacatgttt

SEQ ID NO: 268 - DNA, 85 bp, Artificial
  Synthetic Oligonucleotide
ggaatctctttccatagaatgttctaaaccatcctgcggcctctactctgcattcaattacatactgacacattcggcaacatgt

SEQ ID NO: 269 - DNA, 85 bp, Artificial
  Synthetic Oligonucleotide
gtggaatctctttccatagaatgttctaaaccatcctgcggcctctactctgcattcaattacatactgacacattcggcaacat

SEQ ID NO: 270 - DNA, 85 bp, Artificial
  Synthetic Oligonucleotide
gactggaatctctttccatagaatgttctaaaccatcctgcggcctctactctgcattcaattacatactgacacattcggcaac

SEQ ID NO: 271 - DNA, 85 bp, Artificial
  Synthetic Oligonucleotide
ggaactggaatctctttccatagaatgttctaaaccatcctgcggcctctactctgcattcaattacatactgacacattcggca

SEQ ID NO: 272 - DNA, 85 bp, Artificial
  Synthetic Oligonucleotide
gtggaactggaatctctttccatagaatgttctaaaccatcctgcggcctctactctgcattcaattacatactgacacattcgg

SEQ ID NO: 273 - DNA, 85 bp, Artificial
  Synthetic Oligonucleotide
gcctggaactggaatctctttccatagaatgttctaaaccatcctgcggcctctactctgcattcaattacatactgacacattc

SEQ ID NO: 274 - DNA, 85 bp, Artificial
  Synthetic Oligonucleotide
gttcctggaactggaatctctttccatagaatgttctaaaccatcctgcggcctctactctgcattcaattacatactgacacat

SEQ ID NO: 275 - DNA, 85 bp, Artificial
  Synthetic Oligonucleotide
gggttcctggaactggaatctctttccatagaatgttctaaaccatcctgcggcctctactctgcattcaattacatactgacac

SEQ ID NO: 276 - DNA, 85 bp, Artificial
  Synthetic Oligonucleotide
gcaggttcctggaactggaatctctttccatagaatgttctaaaccatcctgcggcctctactctgcattcaattacatactgac

SEQ ID NO: 277 - DNA, 85 bp, Artificial
  Synthetic Oligonucleotide
gaccaggttcctggaactggaatctctttccatagaatgttctaaaccatcctgcggcctctactctgcattcaattacatactg

SEQ ID NO: 278 - DNA, 85 bp, Artificial
  Synthetic Oligonucleotide
ggtaccaggttcctggaactggaatctctttccatagaatgttctaaaccatcctgcggcctctactctgcattcaattacatac

SEQ ID NO: 279 - DNA, 85 bp, Artificial
  Synthetic Oligonucleotide
gatgtaccaggttcctggaactggaatctctttccatagaatgttctaaaccatcctgcggcctctactctgcattcaattacat

SEQ ID NO: 280 - DNA, 85 bp, Artificial
  Synthetic Oligonucleotide
ggtatgtaccaggttcctggaactggaatctctttccatagaatgttctaaaccatcctgcggcctctactctgcattcaattac

SEQ ID NO: 281 - DNA, 85 bp, Artificial
  Synthetic Oligonucleotide
gacgtatgtaccaggttcctggaactggaatctctttccatagaatgttctaaaccatcctgcggcctctactctgcattcaatt

SEQ ID NO: 282 - DNA, 85 bp, Artificial
  Synthetic Oligonucleotide
gacacgtatgtaccaggttcctggaactggaatctctttccatagaatgttctaaaccatcctgcggcctctactctgcattcaa

SEQ ID NO: 283 - DNA, 85 bp, Artificial
  Synthetic Oligonucleotide
gcaacacgtatgtaccaggttcctggaactggaatctctttccatagaatgttctaaaccatcctgcggcctctactctgcattc

SEQ ID NO: 284 - DNA, 85 bp, Artificial
  Synthetic Oligonucleotide
gcccaacacgtatgtaccaggttcctggaactggaatctctttccatagaatgttctaaaccatcctgcggcctctactctgcat

SEQ ID NO: 285 - DNA, 85 bp, Artificial
  Synthetic Oligonucleotide
ggacccaacacgtatgtaccaggttcctggaactggaatctctttccatagaatgttctaaaccatcctgcggcctctactctgc

SEQ ID NO: 286 - DNA, 85 bp, Artificial
  Synthetic Oligonucleotide
gttgacccaacacgtatgtaccaggttcctggaactggaatctctttccatagaatgttctaaaccatcctgcggcctctactct

SEQ ID NO: 287 - DNA, 85 bp, Artificial
  Synthetic Oligonucleotide
gccttgacccaacacgtatgtaccaggttcctggaactggaatctctttccatagaatgttctaaaccatcctgcggcctctact

SEQ ID NO: 288 - DNA, 85 bp, Artificial
  Synthetic Oligonucleotide
gttccttgacccaacacgtatgtaccaggttcctggaactggaatctctttccatagaatgttctaaaccatcctgcggcctcta

SEQ ID NO: 289 - DNA, 85 bp, Artificial
  Synthetic Oligonucleotide
gggttccttgacccaacacgtatgtaccaggttcctggaactggaatctctttccatagaatgttctaaaccatcctgcggcctc

SEQ ID NO: 290 - DNA, 85 bp, Artificial
  Synthetic Oligonucleotide
gttggttccttgacccaacacgtatgtaccaggttcctggaactggaatctctttccatagaatgttctaaaccatcctgcggcc

SEQ ID NO: 291 - DNA, 85 bp, Artificial
  Synthetic Oligonucleotide
gccttggttccttgacccaacacgtatgtaccaggttcctggaactggaatctctttccatagaatgttctaaaccatcctgcgg

SEQ ID NO: 292 - DNA, 85 bp, Artificial
  Synthetic Oligonucleotide
ggcccttggttccttgacccaacacgtatgtaccaggttcctggaactggaatctctttccatagaatgttctaaaccatcctgc

SEQ ID NO: 293 - DNA, 85 bp, Artificial
  Synthetic Oligonucleotide
gccgcccttggttccttgacccaacacgtatgtaccaggttcctggaactggaatctctttccatagaatgttctaaaccatcct

SEQ ID NO: 294 - DNA, 85 bp, Artificial
  Synthetic Oligonucleotide
gcgccgcccttggttccttgacccaacacgtatgtaccaggttcctggaactggaatctctttccatagaatgttctaaaccatc

SEQ ID NO: 295 - DNA, 85 bp, Artificial
  Synthetic Oligonucleotide
ggtcgccgcccttggttccttgacccaacacgtatgtaccaggttcctggaactggaatctctttccatagaatgttctaaacca

SEQ ID NO: 296 - protein, 7 aa, Artificial
  Synthetic Peptide
GSGGGGS

SEQ ID NO: 297 - protein, 20 aa, Artificial
  Synthetic Peptide
GGGGSGGGGSGGGGSEAAAK

SEQ ID NO: 298 - protein, 18 aa, Artificial
  Synthetic Peptide
GGSGGSGGSGGSGGSGGS

SEQ ID NO: 299 - protein, 16 aa, Artificial
  Synthetic Peptide
SGSETPGTSESATPES

SEQ ID NO: 300 - RNA, 28 nt, Artificial
  Synthetic Oligonucleotide
gccagcuuuccgggcauuggcuuccauc

SEQ ID NO: 301 - DNA, 28 bp, Artificial
  Synthetic Oligonucleotide
gccagctttccgggcattggcttccatc

SEQ ID NO: 302 - DNA, 28 bp, Artificial
  Synthetic Oligonucleotide
acccaggaatctcaggaatgtcgacgat

SEQ ID NO: 303 - DNA, 28 bp, Artificial
  Synthetic Oligonucleotide
agggttttcccagtcacgacgttgtaaa

SEQ ID NO: 304 - DNA, 30 bp, Artificial
  Synthetic Oligonucleotide
gggcattggcttccatctctttgagcacct

SEQ ID NO: 305 - RNA, 30 nt, Artificial
  Synthetic Oligonucleotide
gugcagccagcuuuccgggcauuggcuucc

SEQ ID NO: 306 - RNA, 30 nt, Artificial
  Synthetic Oligonucleotide
gcagccagcuuuccgggcauuggcuuccau

SEQ ID NO: 307 - RNA, 30 nt, Artificial
  Synthetic Oligonucleotide
ggcuuccaucucuuugagcaccuccagcgg

SEQ ID NO: 308 - RNA, 30 nt, Artificial
  Synthetic Oligonucleotide
ggaaugucgacgaucgccucgccuaugccg

SEQ ID NO: 309 - RNA, 30 nt, Artificial
  Synthetic Oligonucleotide
gaaugucgacgaucgccucgccuaugccgc

SEQ ID NO: 310 - RNA, 30 nt, Artificial
  Synthetic Oligonucleotide
gaccugugcgaugaacugcuccaugggcuc

SEQ ID NO: 311 - RNA, 30 nt, Artificial
  Synthetic Oligonucleotide
guguggcagcguccugggaugaacuucuuc

SEQ ID NO: 312 - RNA, 30 nt, Artificial
  Synthetic Oligonucleotide
guggcagcguccugggaugaacuucuucau

SEQ ID NO: 313 - RNA, 30 nt, Artificial
  Synthetic Oligonucleotide
gcuucuugccgggcaacuucccgcggucag

SEQ ID NO: 314 - RNA, 31 nt, Artificial
  Synthetic Oligonucleotide
gcaggguuuucccagucacgacguuguaaaa

SEQ ID NO: 315 - RNA, 31 nt, Artificial; identical to SEQ ID NO: 314
  Synthetic Oligonucleotide

SEQ ID NO: 316 - RNA, 28 nt, Artificial
  Synthetic Oligonucleotide
acccaggaaucucaggaaugucgacgau

SEQ ID NO: 317 - DNA, 21 bp, Artificial
  Synthetic Oligonucleotide
cagctttccgggcattggctt

SEQ ID NO: 318 - RNA, 30 nt, Artificial
  Synthetic Oligonucleotide
ccgcuggaggugcucaaagagauggaagcc

SEQ ID NO: 319 - DNA, 28 bp, Artificial
  Synthetic Oligonucleotide
gccagctttccgggcattggcttccatc

SEQ ID NO: 320 - DNA, 28 bp, Artificial
  Synthetic Oligonucleotide
acccaggaatctcaggaatgtcgacgat

SEQ ID NO: 321 - DNA, 30 bp, Artificial; identical to SEQ ID NO: 304
  Synthetic Oligonucleotide

SEQ ID NO: 322 - RNA, 30 nt, Artificial; identical to SEQ ID NO: 309
  Synthetic Oligonucleotide

SEQ ID NO: 323 - DNA, 28 bp, Artificial
  Synthetic Oligonucleotide
caaggcactcttgcctacgccaccagct

SEQ ID NO: 324 - DNA, 28 bp, Artificial
  Synthetic Oligonucleotide
tcatattcgtccacaaaatgattctgaa

SEQ ID NO: 325 - DNA, 28 bp, Artificial
  Synthetic Oligonucleotide
attatttatggcaaatacacaaagaaag

SEQ ID NO: 326 - DNA, 28 bp, Artificial
  Synthetic Oligonucleotide
gaatatcttcaaatgatttagtattatt

SEQ ID NO: 327 - DNA, 28 bp, Artificial
  Synthetic Oligonucleotide
accataggtacatcttcagagtccttaa

SEQ ID NO: 328 - DNA, 30 bp, Artificial
  Synthetic Oligonucleotide
gtcaaggcactcttgcctacgccaccagct

SEQ ID NO: 329 - DNA, 30 bp, Artificial
  Synthetic Oligonucleotide
gatcatattcgtccacaaaatgattctgaa

SEQ ID NO: 330 - DNA, 30 bp, Artificial
  Synthetic Oligonucleotide
gtattatttatggcaaatacacaaagaaag

SEQ ID NO: 331 - DNA, 30 bp, Artificial
  Synthetic Oligonucleotide
gtgaatatcttcaaatgatttagtattatt

SEQ ID NO: 332 - DNA, 30 bp, Artificial
  Synthetic Oligonucleotide
ggaccataggtacatcttcagagtccttaa

SEQ ID NO: 333 - DNA, 50 bp, Artificial
  Synthetic Oligonucleotide
aagagtgccttgacgatacagcctcgaggctgtatcgtcaaggcactctt

SEQ ID NO: 334 - DNA, 48 bp, Artificial
  Synthetic Oligonucleotide
aatcattttgtggacgaatatctcgagatattcgtccacaaaatgatt

SEQ ID NO: 335 - DNA, 48 bp, Artificial
  Synthetic Oligonucleotide
aaataatactaaatcatttgactcgagtcaaatgatttagtattattt

SEQ ID NO: 336 - DNA, 48 bp, Artificial
  Synthetic Oligonucleotide
aataatactaaatcatttgaactcgagttcaaatgatttagtattatt

SEQ ID NO: 337 - DNA, 48 bp, Artificial
  Synthetic Oligonucleotide
aaggactctgaagatgtacctctcgagaggtacatcttcagagtcctt

SEQ ID NO: 338 - DNA, 30 bp, Artificial
  Synthetic Oligonucleotide
gagatcagggcaaacagaactttgactccc

SEQ ID NO: 339 - DNA, 30 bp, Artificial
  Synthetic Oligonucleotide
ggatgcagatcagggcaaacagaactttga

SEQ ID NO: 340 - DNA, 30 bp, Artificial
  Synthetic Oligonucleotide
gcacagcgatgcagatcagggcaaacagaa

SEQ ID NO: 341 - DNA, 30 bp, Artificial
  Synthetic Oligonucleotide
gctcggccacagcgatgcagatcagggcaa

SEQ ID NO: 342 - DNA, 30 bp, Artificial
  Synthetic Oligonucleotide
ggggcttggcctcggccacagcgatgcaga

SEQ ID NO: 343 - DNA, 30 bp, Artificial
  Synthetic Oligonucleotide
gtgggcttggcctcggccacagcgatgcag

SEQ ID NO: 344 - DNA, 30 bp, Artificial
  Synthetic Oligonucleotide
gtctcggtgggcttggcctcggccacagcg

SEQ ID NO: 345 - DNA, 30 bp, Artificial
  Synthetic Oligonucleotide
gttcgttgttctcggtgggcttggcctcgg

SEQ ID NO: 346 - DNA, 30 bp, Artificial
  Synthetic Oligonucleotide
ggaagtcttcgttgttctcggtgggcttgg

SEQ ID NO: 347 - DNA, 30 bp, Artificial
  Synthetic Oligonucleotide
gatgttgaagtcttcgttgttctcggtggg

SEQ ID NO: 348 - DNA, 30 bp, Artificial
  Synthetic Oligonucleotide
gcggccacgatgttgaagtcttcgttgttc

SEQ ID NO: 349 - DNA, 30 bp, Artificial
  Synthetic Oligonucleotide
gtggccacggccacgatgttgaagtcttcg

SEQ ID NO: 350 - DNA, 30 bp, Artificial
  Synthetic Oligonucleotide
ggttgctggccacggccacgatgttgaagt

SEQ ID NO: 351 - DNA, 30 bp, Artificial
  Synthetic Oligonucleotide
gtcgcgaagttgctggccacggccacgatg

SEQ ID NO: 352 - DNA, 30 bp, Artificial
  Synthetic Oligonucleotide
gccgtggtcgcgaagttgctggccacggcc

SEQ ID NO: 353 - DNA, 30 bp, Artificial
  Synthetic Oligonucleotide
gcgagatccgtggtcgcgaagttgctggcc

SEQ ID NO: 354 - DNA, 30 bp, Artificial
  Synthetic Oligonucleotide
gcagcatcgagatccgtggtcgcgaagttg

SEQ ID NO: 355 - DNA, 30 bp, Artificial
  Synthetic Oligonucleotide
gggtcagcatcgagatccgtggtcgcgaag

SEQ ID NO: 356 - DNA, 30 bp, Artificial
  Synthetic Oligonucleotide
gcttcccgcggtcagcatcgagatccgtgg

SEQ ID NO: 357 - DNA, 30 bp, Artificial
  Synthetic Oligonucleotide
ggggcaacttcccgcggtcagcatcgagat

SEQ ID NO: 358 - DNA, 30 bp, Artificial
  Synthetic Oligonucleotide
gtcttgccgggcaacttcccgcggtcagca

SEQ ID NO: 359 - DNA, 30 bp, Artificial
  Synthetic Oligonucleotide
ggcagcttcttgccgggcaacttcccgcgg

SEQ ID NO: 360 - DNA, 30 bp, Artificial
  Synthetic Oligonucleotide
gccagcggcagcttcttgccgggcaacttc

SEQ ID NO: 361 - DNA, 30 bp, Artificial
  Synthetic Oligonucleotide
gcacctccagcggcagcttcttgccgggca

SEQ ID NO: 362 - DNA, 30 bp, Artificial
  Synthetic Oligonucleotide
gctttgagcacctccagcggcagcttcttg

SEQ ID NO: 363 - DNA, 30 bp, Artificial
  Synthetic Oligonucleotide
gcatctctttgagcacctccagcggcagct

SEQ ID NO: 364 - DNA, 30 bp, Artificial
  Synthetic Oligonucleotide
gtccatctctttgagcacctccagcggcag

SEQ ID NO: 365 - DNA, 30 bp, Artificial; identical to SEQ ID NO: 304
  Synthetic Oligonucleotide

SEQ ID NO: 366 - DNA, 30 bp, Artificial
  Synthetic Oligonucleotide
gtccgggcattggcttccatctctttgagc

SEQ ID NO: 367 - DNA, 30 bp, Artificial
  Synthetic Oligonucleotide
ggccagctttccgggcattggcttccatct

SEQ ID NO: 368 - DNA, 30 bp, Artificial
  Synthetic Oligonucleotide
gggtgcagccagctttccgggcattggctt

SEQ ID NO: 369 - DNA, 30 bp, Artificial
  Synthetic Oligonucleotide
gagcccctggtgcagccagctttccgggca

SEQ ID NO: 370 - DNA, 30 bp, Artificial
  Synthetic Oligonucleotide
gatcagacagcccctggtgcagccagcttt

SEQ ID NO: 371 - DNA, 30 bp, Artificial
  Synthetic Oligonucleotide
ggcagatcagacagcccctggtgcagccag

SEQ ID NO: 372 - DNA, 30 bp, Artificial
  Synthetic Oligonucleotide
gacaggcagatcagacagcccctggtgcag

SEQ ID NO: 373 - DNA, 30 bp, Artificial
  Synthetic Oligonucleotide
gtgatgtgggacaggcagatcagacagccc

SEQ ID NO: 374 - DNA, 30 bp, Artificial
  Synthetic Oligonucleotide
gacttgatgtgggacaggcagatcagacag

SEQ ID NO: 375 - DNA, 30 bp, Artificial
  Synthetic Oligonucleotide
ggggcgtgcacttgatgtgggacaggcaga

SEQ ID NO: 376 - DNA, 30 bp, Artificial
  Synthetic Oligonucleotide
gcttcatcttgggcgtgcacttgatgtggg

SEQ ID NO: 377 - DNA, 30 bp, Artificial
  Synthetic Oligonucleotide
gtgaacttcttcatcttgggcgtgcacttg

SEQ ID NO: 378 - DNA, 30 bp, Artificial
  Synthetic Oligonucleotide
gggatgaacttcttcatcttgggcgtgcac

SEQ ID NO: 379 - DNA, 30 bp, Artificial
  Synthetic Oligonucleotide
gtgggatgaacttcttcatcttgggcgtgc

SEQ ID NO: 380 - DNA, 30 bp, Artificial
  Synthetic Oligonucleotide
gggcagcgtcctgggatgaacttcttcatc

SEQ ID NO: 381 - DNA, 30 bp, Artificial
  Synthetic Oligonucleotide
gggtgtggcagcgtcctgggatgaacttct

SEQ ID NO: 382 - DNA, 30 bp, Artificial
  Synthetic Oligonucleotide
gttcgtaggtgtggcagcgtcctgggatga

SEQ ID NO: 383 - DNA, 30 bp, Artificial
  Synthetic Oligonucleotide
gcgccttcgtaggtgtggcagcgtcctggg

SEQ ID NO: 384 - DNA, 30 bp, Artificial
  Synthetic Oligonucleotide
gtctttgtcgccttcgtaggtgtggcagcg

SEQ ID NO: 385 - DNA, 30 bp, Artificial
  Synthetic Oligonucleotide
gctttgtcgccttcgtaggtgtggcagcgt

SEQ ID NO: 386 - DNA, 30 bp, Artificial
  Synthetic Oligonucleotide
gtgccgccctgtgcggactctttgtcgcct

SEQ ID NO: 387 - DNA, 30 bp, Artificial
  Synthetic Oligonucleotide
gtatgccgccctgtgcggactctttgtcgc

SEQ ID NO: 388 - DNA, 30 bp, Artificial
  Synthetic Oligonucleotide
gcctcgcctatgccgccctgtgcggactct

SEQ ID NO: 389 - DNA, 30 bp, Artificial
  Synthetic Oligonucleotide
ggatcgcctcgcctatgccgccctgtgcgg

SEQ ID NO: 390 - DNA, 30 bp, Artificial
  Synthetic Oligonucleotide
gatgtcgacgatcgcctcgcctatgccgcc

SEQ ID NO: 391 - DNA, 30 bp, Artificial
  Synthetic Oligonucleotide
gcaggaatgtcgacgatcgcctcgcctatg

SEQ ID NO: 392 - DNA, 30 bp, Artificial
  Synthetic Oligonucleotide
gaatctcaggaatgtcgacgatcgcctcgc

SEQ ID NO: 393 - DNA, 30 bp, Artificial
  Synthetic Oligonucleotide
gcccaggaatctcaggaatgtcgacgatcg

SEQ ID NO: 394 - DNA, 30 bp, Artificial
  Synthetic Oligonucleotide
gccttgaacccaggaatctcaggaatgtcg

SEQ ID NO: 395 - DNA, 30 bp, Artificial
  Synthetic Oligonucleotide
gccaagtccttgaacccaggaatctcagga

SEQ ID NO: 396 - DNA, 30 bp, Artificial
  Synthetic Oligonucleotide
gtgggctccaagtccttgaacccaggaatc

SEQ ID NO: 397 - DNA, 30 bp, Artificial
  Synthetic Oligonucleotide
gccatgggctccaagtccttgaacccagga

SEQ ID NO: 398 - DNA, 30 bp, Artificial
  Synthetic Oligonucleotide
ggaactgctccatgggctccaagtccttga

SEQ ID NO: 399 - DNA, 30 bp, Artificial
  Synthetic Oligonucleotide
gtgcgatgaactgctccatgggctccaagt

SEQ ID NO: 400 - DNA, 30 bp, Artificial
  Synthetic Oligonucleotide
ggacctgtgcgatgaactgctccatgggct

SEQ ID NO: 401 - DNA, 30 bp, Artificial
  Synthetic Oligonucleotide
gacagatcgacctgtgcgatgaactgctcc

SEQ ID NO: 402 - DNA, 30 bp, Artificial
  Synthetic Oligonucleotide
gacacacagatcgacctgtgcgatgaactg

SEQ ID NO: 403 - DNA, 30 bp, Artificial
  Synthetic Oligonucleotide
gtgcagtccacacacagatcgacctgtgcg

SEQ ID NO: 404 - DNA, 30 bp, Artificial
  Synthetic Oligonucleotide
gccagttgtgcagtccacacacagatcgac

SEQ ID NO: 405 - DNA, 30 bp, Artificial
  Synthetic Oligonucleotide
gggcagccagttgtgcagtccacacacaga

SEQ ID NO: 406 - DNA, 30 bp, Artificial
  Synthetic Oligonucleotide
gtttgaggcagccagttgtgcagtccacac

SEQ ID NO: 407 - DNA, 30 bp, Artificial
  Synthetic Oligonucleotide
gaagccctttgaggcagccagttgtgcagt

SEQ ID NO: 408 - DNA, 30 bp, Artificial
  Synthetic Oligonucleotide
gcacgttggcaagccctttgaggcagccag

SEQ ID NO: 409 - DNA, 30 bp, Artificial
  Synthetic Oligonucleotide
gactgcacgttggcaagccctttgaggcag

SEQ ID NO: 410 - DNA, 30 bp, Artificial
  Synthetic Oligonucleotide
gggtcagaacactgcacgttggcaagccct

SEQ ID NO: 411 - DNA, 30 bp, Artificial
  Synthetic Oligonucleotide
gcaggtcagaacactgcacgttggcaagcc

SEQ ID NO: 412 - DNA, 30 bp, Artificial
  Synthetic Oligonucleotide
gagcaggtcagaacactgcacgttggcaag

SEQ ID NO: 413 - DNA, 30 bp, Artificial
  Synthetic Oligonucleotide
ggccacttcttgagcaggtcagaacactgc

SEQ ID NO: 414 - DNA, 30 bp, Artificial
  Synthetic Oligonucleotide
gcggcagccacttcttgagcaggtcagaac

SEQ ID NO: 415 - DNA, 30 bp, Artificial
  Synthetic Oligonucleotide
gtgcggcagccacttcttgagcaggtcaga

SEQ ID NO: 416 - DNA, 30 bp, Artificial
  Synthetic Oligonucleotide
gagcgttgcggcagccacttcttgagcagg

SEQ ID NO: 417 - DNA, 30 bp, Artificial
  Synthetic Oligonucleotide
gaaaggtcgcacagcgttgcggcagccact

SEQ ID NO: 418 - DNA, 30 bp, Artificial
  Synthetic Oligonucleotide
gctggcaaaggtcgcacagcgttgcggcag

SEQ ID NO: 419 - DNA, 30 bp, Artificial
  Synthetic Oligonucleotide
gggcaaaggtcgcacagcgttgcggcagcc

SEQ ID NO: 420 - DNA, 30 bp, Artificial
  Synthetic Oligonucleotide
gtggatcttgctggcaaaggtcgcacagcg

SEQ ID NO: 421 - DNA, 30 bp, Artificial
  Synthetic Oligonucleotide
gcacctggccctggatcttgctggcaaagg

SEQ ID NO: 422 - DNA, 30 bp, Artificial
  Synthetic Oligonucleotide
gtggccctggatcttgctggcaaaggtcgc

SEQ ID NO: 423 - DNA, 30 bp, Artificial
  Synthetic Oligonucleotide
gtgatcttgtccacctggccctggatcttg

SEQ ID NO: 424 - DNA, 30 bp, Artificial
  Synthetic Oligonucleotide
gccccttgatcttgtccacctggccctgga

SEQ ID NO: 425 - DNA, 30 bp, Artificial
  Synthetic Oligonucleotide
gcccttgatcttgtccacctggccctggat

SEQ ID NO: 426 - DNA, 30 bp, Artificial
  Synthetic Oligonucleotide
gccttgatcttgtccacctggccctggatc

SEQ ID NO: 427 - DNA, 30 bp, Artificial
  Synthetic Oligonucleotide
ggcaaaggtcgcacagcgttgcggcagcca

SEQ ID NO: 428 - DNA, 30 bp, Artificial
  Synthetic Oligonucleotide
gcaaaggtcgcacagcgttgcggcagccac

SEQ ID NO: 429 - DNA, 30 bp, Artificial
  Synthetic Oligonucleotide
gaaggtcgcacagcgttgcggcagccactt

SEQ ID NO: 430 - DNA, 30 bp, Artificial
  Synthetic Oligonucleotide
gaggtcgcacagcgttgcggcagccacttc

SEQ ID NO: 431 - DNA, 31 bp, Artificial
  Synthetic Oligonucleotide
ggtaatgcctggcttgtcgacgcatagtctg

SEQ ID NO: 432 - DNA, 31 bp, Artificial
  Synthetic Oligonucleotide
gggaaccttggccgttataaagtctgaccag

SEQ ID NO: 433 - DNA, 31 bp, Artificial
  Synthetic Oligonucleotide
ggagggtgagaatttagaaccaagattgttg

SEQ ID NO: 434 - DNA, 30 bp, Artificial
  Synthetic Oligonucleotide
gagtcctggcaatgaacagtggcgcagtag

SEQ ID NO: 435 - DNA, 30 bp, Artificial
  Synthetic Oligonucleotide
gggtgccacagctgctatcaatacattctc

SEQ ID NO: 436 - DNA, 30 bp, Artificial
  Synthetic Oligonucleotide
gttacatactgacacattcggcaacatgtt

SEQ ID NO: 437 - DNA, 30 bp, Artificial
  Synthetic Oligonucleotide
gtatgtaccaggttcctggaactggaatct

SEQ ID NO: 438 - DNA, 30 bp, Artificial
  Synthetic Oligonucleotide
gccttggttccatccaggttctccagggtg

SEQ ID NO: 439 - DNA, 30 bp, Artificial
  Synthetic Oligonucleotide
gcagtgatgggattctcagtagcttgagcg

SEQ ID NO: 440 - DNA, 30 bp, Artificial
  Synthetic Oligonucleotide
gagcctggcatctcaacaacagcgatggtg

SEQ ID NO: 441 - DNA, 30 bp, Artificial
  Synthetic Oligonucleotide
gtgtctggggcgattcttacagatcttcct

SEQ ID NO: 442 - DNA, 30 bp, Artificial
  Synthetic Oligonucleotide
gctggatctgaagtgaagtctgtatcttcc

SEQ ID NO: 443 - DNA, 30 bp, Artificial
  Synthetic Oligonucleotide
ggcaacgtcatcaggatttccatagagtgg

SEQ ID NO: 444 - DNA, 30 bp, Artificial
  Synthetic Oligonucleotide
gaggcgcaggagatggtgtagtagtagaag

SEQ ID NO: 445 - DNA, 30 bp, Artificial
  Synthetic Oligonucleotide
gagggaccctggaattggtatcttgctttg

SEQ ID NO: 446 - DNA, 30 bp, Artificial
  Synthetic Oligonucleotide
ggtaagagtcaacattcctgtgtgaaacct

SEQ ID NO: 447 - DNA, 30 bp, Artificial
  Synthetic Oligonucleotide
gaccagaatctgttttccatcaacaatgag

SEQ ID NO: 448 - DNA, 30 bp, Artificial
  Synthetic Oligonucleotide
gatggctgtagtcagtatgtcaccatcttg

SEQ ID NO: 449 - DNA, 30 bp, Artificial
  Synthetic Oligonucleotide
gtaccatcgaatggatctctaatatgtacg

SEQ ID NO: 450 - DNA, 30 bp, Artificial
  Synthetic Oligonucleotide
gagatcacaggctccttcagcatcaaaaga

SEQ ID NO: 451 - DNA, 30 bp, Artificial
  Synthetic Oligonucleotide
gctttgaccggcgaagagactattgcagag

SEQ ID NO: 452 - DNA, 30 bp, Artificial
  Synthetic Oligonucleotide
gcccctcaggcaatactcgtacatgcatcg

SEQ ID NO: 453 - DNA, 30 bp, Artificial
  Synthetic Oligonucleotide
gctggtacttctagggtgtctccatgcttt

SEQ ID NO: 454 - DNA, 31 bp, Artificial; identical to SEQ ID NO: 431
  Synthetic Oligonucleotide

SEQ ID NO: 455 - DNA, 31 bp, Artificial; identical to SEQ ID NO: 432
  Synthetic Oligonucleotide

SEQ ID NO: 456 - DNA, 31 bp, Artificial; identical to SEQ ID NO: 433
  Synthetic Oligonucleotide

SEQ ID NO: 457 - DNA, 31 bp, Artificial; identical to SEQ ID NO: 179
  Synthetic Oligonucleotide

SEQ ID NO: 458 - DNA, 31 bp, Artificial; identical to SEQ ID NO: 180
  Synthetic Oligonucleotide

SEQ ID NO: 459 - DNA, 31 bp, Artificial; identical to SEQ ID NO: 181
  Synthetic Oligonucleotide

SEQ ID NO: 460 - DNA, 31 bp, Artificial; identical to SEQ ID NO: 182
  Synthetic Oligonucleotide

SEQ ID NO: 461 - DNA, 31 bp, Artificial; identical to SEQ ID NO: 183
  Synthetic Oligonucleotide

SEQ ID NO: 462 - DNA, 31 bp, Artificial; identical to SEQ ID NO: 184
  Synthetic Oligonucleotide

SEQ ID NO: 463 - DNA, 31 bp, Artificial; identical to SEQ ID NO: 185
  Synthetic Oligonucleotide

SEQ ID NO: 464 - DNA, 31 bp, Artificial; identical to SEQ ID NO: 186
  Synthetic Oligonucleotide

SEQ ID NO: 465 - DNA, 31 bp, Artificial; identical to SEQ ID NO: 187
  Synthetic Oligonucleotide

SEQ ID NO: 466 - DNA, 31 bp, Artificial; identical to SEQ ID NO: 188
  Synthetic Oligonucleotide

SEQ ID NO: 467 - DNA, 31 bp, Artificial; identical to SEQ ID NO: 189
  Synthetic Oligonucleotide

SEQ ID NO: 468 - DNA, 31 bp, Artificial; identical to SEQ ID NO: 190
  Synthetic Oligonucleotide

SEQ ID NO: 469 - DNA, 31 bp, Artificial; identical to SEQ ID NO: 191
  Synthetic Oligonucleotide

SEQ ID NO: 470 - DNA, 31 bp, Artificial; identical to SEQ ID NO: 192
  Synthetic Oligonucleotide

SEQ ID NO: 471 - DNA, 31 bp, Artificial; identical to SEQ ID NO: 193
  Synthetic Oligonucleotide

SEQ ID NO: 472 - DNA, 51 bp, Artificial; identical to SEQ ID NO: 194
  Synthetic Oligonucleotide

SEQ ID NO: 473 - DNA, 51 bp, Artificial; identical to SEQ ID NO: 195
  Synthetic Oligonucleotide

SEQ ID NO: 474 - DNA, 51 bp, Artificial; identical to SEQ ID NO: 196
  Synthetic Oligonucleotide

SEQ ID NO: 475 - DNA, 51 bp, Artificial; identical to SEQ ID NO: 197
  Synthetic Oligonucleotide

SEQ ID NO: 476 - DNA, 51 bp, Artificial; identical to SEQ ID NO: 198
  Synthetic Oligonucleotide

SEQ ID NO: 477 - DNA, 51 bp, Artificial; identical to SEQ ID NO: 199
  Synthetic Oligonucleotide

SEQ ID NO: 478 - DNA, 51 bp, Artificial; identical to SEQ ID NO: 200
  Synthetic Oligonucleotide

SEQ ID NO: 479 - DNA, 51 bp, Artificial; identical to SEQ ID NO: 201
  Synthetic Oligonucleotide

SEQ ID NO: 480 - DNA, 51 bp, Artificial; identical to SEQ ID NO: 202
  Synthetic Oligonucleotide

SEQ ID NO: 481 - DNA, 51 bp, Artificial; identical to SEQ ID NO: 203
  Synthetic Oligonucleotide

SEQ ID NO: 482 - DNA, 51 bp, Artificial; identical to SEQ ID NO: 204
  Synthetic Oligonucleotide

SEQ ID NO: 483 - DNA, 51 bp, Artificial; identical to SEQ ID NO: 205
  Synthetic Oligonucleotide

SEQ ID NO: 484 - DNA, 51 bp, Artificial; identical to SEQ ID NO: 206
  Synthetic Oligonucleotide

SEQ ID NO: 485 - DNA, 51 bp, Artificial; identical to SEQ ID NO: 207
  Synthetic Oligonucleotide

SEQ ID NO: 486 - DNA, 51 bp, Artificial; identical to SEQ ID NO: 208
  Synthetic Oligonucleotide

SEQ ID NO: 487 - DNA, 51 bp, Artificial; identical to SEQ ID NO: 209
  Synthetic Oligonucleotide

SEQ ID NO: 488 - DNA, 51 bp, Artificial; identical to SEQ ID NO: 210
  Synthetic Oligonucleotide

SEQ ID NO: 489 - DNA, 51 bp, Artificial; identical to SEQ ID NO: 211
  Synthetic Oligonucleotide

SEQ ID NO: 490 - DNA, 51 bp, Artificial; identical to SEQ ID NO: 212
  Synthetic Oligonucleotide

SEQ ID NO: 491 - DNA, 51 bp, Artificial; identical to SEQ ID NO: 213
  Synthetic Oligonucleotide

SEQ ID NO: 492 - DNA, 51 bp, Artificial; identical to SEQ ID NO: 214
  Synthetic Oligonucleotide

SEQ ID NO: 493 - DNA, 51 bp, Artificial; identical to SEQ ID NO: 215
  Synthetic Oligonucleotide

SEQ ID NO: 494 - DNA, 51 bp, Artificial; identical to SEQ ID NO: 216
  Synthetic Oligonucleotide

SEQ ID NO: 495 - DNA, 51 bp, Artificial; identical to SEQ ID NO: 217
  Synthetic Oligonucleotide

SEQ ID NO: 496 - DNA, 51 bp, Artificial; identical to SEQ ID NO: 218
  Synthetic Oligonucleotide

SEQ ID NO: 497 - DNA, 71 bp, Artificial; identical to SEQ ID NO: 219
  Synthetic Oligonucleotide

SEQ ID NO: 498 - DNA, 71 bp, Artificial; identical to SEQ ID NO: 220
  Synthetic Oligonucleotide

SEQ ID NO: 499 - DNA, 71 bp, Artificial; identical to SEQ ID NO: 221
  Synthetic Oligonucleotide

SEQ ID NO: 500 - DNA, 71 bp, Artificial; identical to SEQ ID NO: 222
  Synthetic Oligonucleotide

SEQ ID NO: 501 - DNA, 71 bp, Artificial; identical to SEQ ID NO: 223
  Synthetic Oligonucleotide

SEQ ID NO: 502 - DNA, 71 bp, Artificial; identical to SEQ ID NO: 224
  Synthetic Oligonucleotide

SEQ ID NO: 503 - DNA, 71 bp, Artificial; identical to SEQ ID NO: 225
  Synthetic Oligonucleotide

SEQ ID NO: 504 - DNA, 71 bp, Artificial; identical to SEQ ID NO: 226
  Synthetic Oligonucleotide

SEQ ID NO: 505 - DNA, 71 bp, Artificial; identical to SEQ ID NO: 227
  Synthetic Oligonucleotide

SEQ ID NO: 506 - DNA, 71 bp, Artificial; identical to SEQ ID NO: 228
  Synthetic Oligonucleotide

SEQ ID NO: 507 - DNA, 71 bp, Artificial; identical to SEQ ID NO: 229
  Synthetic Oligonucleotide

SEQ ID NO: 508 - DNA, 71 bp, Artificial; identical to SEQ ID NO: 230
  Synthetic Oligonucleotide

SEQ ID NO: 509 - DNA, 71 bp, Artificial; identical to SEQ ID NO: 231
  Synthetic Oligonucleotide

SEQ ID NO: 510 - DNA, 71 bp, Artificial; identical to SEQ ID NO: 232
  Synthetic Oligonucleotide

SEQ ID NO: 511 - DNA, 71 bp, Artificial; identical to SEQ ID NO: 233
  Synthetic Oligonucleotide

SEQ ID NO: 512 - DNA, 71 bp, Artificial; identical to SEQ ID NO: 234
  Synthetic Oligonucleotide

SEQ ID NO: 513 - DNA, 71 bp, Artificial; identical to SEQ ID NO: 235
  Synthetic Oligonucleotide

SEQ ID NO: 514 - DNA, 71 bp, Artificial; identical to SEQ ID NO: 236
  Synthetic Oligonucleotide

SEQ ID NO: 515 - DNA, 71 bp, Artificial; identical to SEQ ID NO: 237
  Synthetic Oligonucleotide

SEQ ID NO: 516 - DNA, 71 bp, Artificial; identical to SEQ ID NO: 238
  Synthetic Oligonucleotide

SEQ ID NO: 517 - DNA, 71 bp, Artificial; identical to SEQ ID NO: 239
  Synthetic Oligonucleotide

SEQ ID NO: 518 - DNA, 71 bp, Artificial; identical to SEQ ID NO: 240
  Synthetic Oligonucleotide

SEQ ID NO: 519 - DNA, 71 bp, Artificial; identical to SEQ ID NO: 241
  Synthetic Oligonucleotide

SEQ ID NO: 520 - DNA, 71 bp, Artificial; identical to SEQ ID NO: 242
  Synthetic Oligonucleotide

SEQ ID NO: 521 - DNA, 71 bp, Artificial; identical to SEQ ID NO: 243
  Synthetic Oligonucleotide

SEQ ID NO: 522 - DNA, 71 bp, Artificial; identical to SEQ ID NO: 244
  Synthetic Oligonucleotide

SEQ ID NO: 523 - DNA, 71 bp, Artificial; identical to SEQ ID NO: 245
  Synthetic Oligonucleotide

SEQ ID NO: 524 - DNA, 71 bp, Artificial; identical to SEQ ID NO: 246
  Synthetic Oligonucleotide

SEQ ID NO: 525 - DNA, 71 bp, Artificial; identical to SEQ ID NO: 247
  Synthetic Oligonucleotide

SEQ ID NO: 526 - DNA, 71 bp, Artificial; identical to SEQ ID NO: 248
  Synthetic Oligonucleotide

SEQ ID NO: 527 - DNA, 71 bp, Artificial; identical to SEQ ID NO: 249
  Synthetic Oligonucleotide

SEQ ID NO: 528 - DNA, 71 bp, Artificial; identical to SEQ ID NO: 250
  Synthetic Oligonucleotide

SEQ ID NO: 529 - DNA, 71 bp, Artificial; identical to SEQ ID NO: 251
  Synthetic Oligonucleotide

SEQ ID NO: 530 - DNA, 71 bp, Artificial; identical to SEQ ID NO: 252
  Synthetic Oligonucleotide

SEQ ID NO: 531 - DNA, 71 bp, Artificial; identical to SEQ ID NO: 253
  Synthetic Oligonucleotide

SEQ ID NO: 532 - DNA, 85 bp, Artificial; identical to SEQ ID NO: 254
  Synthetic Oligonucleotide

SEQ ID NO: 533 - DNA, 85 bp, Artificial; identical to SEQ ID NO: 255
  Synthetic Oligonucleotide

SEQ ID NO: 534 - DNA, 85 bp, Artificial; identical to SEQ ID NO: 256
  Synthetic Oligonucleotide

SEQ ID NO: 535 - DNA, 85 bp, Artificial; identical to SEQ ID NO: 257
  Synthetic Oligonucleotide

SEQ ID NO: 536 - DNA, 85 bp, Artificial; identical to SEQ ID NO: 258
  Synthetic Oligonucleotide

SEQ ID NO: 537 - DNA, 85 bp, Artificial; identical to SEQ ID NO: 259
  Synthetic Oligonucleotide

SEQ ID NO: 538 - DNA, 85 bp, Artificial; identical to SEQ ID NO: 260
  Synthetic Oligonucleotide

SEQ ID NO: 539 - DNA, 85 bp, Artificial; identical to SEQ ID NO: 261
  Synthetic Oligonucleotide

SEQ ID NO: 540 - DNA, 85 bp, Artificial; identical to SEQ ID NO: 262
  Synthetic Oligonucleotide

SEQ ID NO: 541 - DNA, 85 bp, Artificial; identical to SEQ ID NO: 263
  Synthetic Oligonucleotide

SEQ ID NO: 542 - DNA, 85 bp, Artificial; identical to SEQ ID NO: 264
  Synthetic Oligonucleotide

SEQ ID NO: 543 - DNA, 85 bp, Artificial; identical to SEQ ID NO: 265
  Synthetic Oligonucleotide

SEQ ID NO: 544 - DNA, 85 bp, Artificial; identical to SEQ ID NO: 266
  Synthetic Oligonucleotide

SEQ ID NO: 545 - DNA, 85 bp, Artificial; identical to SEQ ID NO: 267
  Synthetic Oligonucleotide

SEQ ID NO: 546 - DNA, 85 bp, Artificial; identical to SEQ ID NO: 268
  Synthetic Oligonucleotide

SEQ ID NO: 547 - DNA, 85 bp, Artificial; identical to SEQ ID NO: 269
  Synthetic Oligonucleotide

SEQ ID NO: 548 - DNA, 85 bp, Artificial; identical to SEQ ID NO: 270
  Synthetic Oligonucleotide

SEQ ID NO: 549 - DNA, 85 bp, Artificial; identical to SEQ ID NO: 271
  Synthetic Oligonucleotide

SEQ ID NO: 550 - DNA, 85 bp, Artificial; identical to SEQ ID NO: 272
  Synthetic Oligonucleotide

SEQ ID NO: 551 - DNA, 85 bp, Artificial; identical to SEQ ID NO: 273
  Synthetic Oligonucleotide

SEQ ID NO: 552 - DNA, 85 bp, Artificial; identical to SEQ ID NO: 274
  Synthetic Oligonucleotide

SEQ ID NO: 553 - DNA, 85 bp, Artificial; identical to SEQ ID NO: 275
  Synthetic Oligonucleotide

SEQ ID NO: 554 - DNA, 85 bp, Artificial; identical to SEQ ID NO: 276
  Synthetic Oligonucleotide

SEQ ID NO: 555 - DNA, 85 bp, Artificial; identical to SEQ ID NO: 277
  Synthetic Oligonucleotide

SEQ ID NO: 556 - DNA, 85 bp, Artificial; identical to SEQ ID NO: 278
  Synthetic Oligonucleotide

SEQ ID NO: 557 - DNA, 85 bp, Artificial; identical to SEQ ID NO: 279
  Synthetic Oligonucleotide

SEQ ID NO: 558 - DNA, 85 bp, Artificial; identical to SEQ ID NO: 280
  Synthetic Oligonucleotide

SEQ ID NO: 559 - DNA, 85 bp, Artificial; identical to SEQ ID NO: 281
  Synthetic Oligonucleotide

SEQ ID NO: 560 - DNA, 85 bp, Artificial; identical to SEQ ID NO: 282
  Synthetic Oligonucleotide

SEQ ID NO: 561 - DNA, 85 bp, Artificial; identical to SEQ ID NO: 283
  Synthetic Oligonucleotide

SEQ ID NO: 562 - DNA, 85 bp, Artificial; identical to SEQ ID NO: 284
  Synthetic Oligonucleotide

SEQ ID NO: 563 - DNA, 85 bp, Artificial; identical to SEQ ID NO: 285
  Synthetic Oligonucleotide

SEQ ID NO: 564 - DNA, 85 bp, Artificial; identical to SEQ ID NO: 286
  Synthetic Oligonucleotide

SEQ ID NO: 565 - DNA, 85 bp, Artificial; identical to SEQ ID NO: 287
  Synthetic Oligonucleotide

SEQ ID NO: 566 - DNA, 85 bp, Artificial; identical to SEQ ID NO: 288
  Synthetic Oligonucleotide

SEQ ID NO: 567 - DNA, 85 bp, Artificial; identical to SEQ ID NO: 289
  Synthetic Oligonucleotide

SEQ ID NO: 568 - DNA, 85 bp, Artificial; identical to SEQ ID NO: 290
  Synthetic Oligonucleotide

SEQ ID NO: 569 - DNA, 85 bp, Artificial; identical to SEQ ID NO: 291
  Synthetic Oligonucleotide

SEQ ID NO: 570 - DNA, 85 bp, Artificial; identical to SEQ ID NO: 292
  Synthetic Oligonucleotide

SEQ ID NO: 571 - DNA, 85 bp, Artificial; identical to SEQ ID NO: 293
  Synthetic Oligonucleotide

SEQ ID NO: 572 - DNA, 85 bp, Artificial; identical to SEQ ID NO: 294
  Synthetic Oligonucleotide

SEQ ID NO: 573 - DNA, 85 bp, Artificial; identical to SEQ ID NO: 295
  Synthetic Oligonucleotide

SEQ ID NO: 574 - DNA, 30 bp, Artificial
  Synthetic Oligonucleotide
gtaatgcctggcttgtcgacgcatagtctg

SEQ ID NO: 575 - DNA, 51 bp, Artificial
  Synthetic Oligonucleotide
gaaaacgcaggttcctccagtttcgggagcagcgcacgtctccctgtagtc

SEQ ID NO: 576 - DNA, 51 bp, Artificial
  Synthetic Oligonucleotide
gacgcaggttcctctagcttcgggagcagcgcacgtctccctgtagtcaag

SEQ ID NO: 577 - DNA, 30 bp, Artificial; identical to SEQ ID NO: 574
  Synthetic Oligonucleotide

SEQ ID NO: 578 - DNA, 51 bp, Artificial; identical to SEQ ID NO: 202
  Synthetic Oligonucleotide

SEQ ID NO: 579 - DNA, 30 bp, Artificial; identical to SEQ ID NO: 574
  Synthetic Oligonucleotide

SEQ ID NO: 580 - DNA, 51 bp, Artificial
  Synthetic Oligonucleotide
gcaaggccacaaaattatccactgtttttggaacagtctttccgaagagac

SEQ ID NO: 581 - DNA, 51 bp, Artificial
  Synthetic Oligonucleotide
gcctgtagccaaggccacaaaattatccactgtttttggaacagtctttcc

SEQ ID NO: 582 - DNA, 51 bp, Artificial
  Synthetic Oligonucleotide
gctttctctcctgtagccaaggccacaaaattatccactgtttttggaaca

SEQ ID NO: 583 - DNA, 51 bp, Artificial
  Synthetic Oligonucleotide
ggccaaatcctttctctcctgtagccaaggccacaaaattatccactgttt

SEQ ID NO: 584 - DNA, 51 bp, Artificial
  Synthetic Oligonucleotide
gtttttgtagccaaatcctttctctcctgtagccaaggccacaaaattatc

SEQ ID NO: 585 - DNA, 51 bp, Artificial
  Synthetic Oligonucleotide
gatttgctgtttttgtagccaaatcctttctctcctgtagccaaggccaca

SEQ ID NO: 586 - DNA, 51 bp, Artificial
  Synthetic Oligonucleotide
gacgatggaatttgctgtttttgtagccaaatcctttctctcctgtagcca

SEQ ID NO: 587 - DNA, 51 bp, Artificial
  Synthetic Oligonucleotide
gatagaatgttctaaacgatcctgcggcctctactctgcattcaattacat

SEQ ID NO: 588 - DNA, 51 bp, Artificial
  Synthetic Oligonucleotide
gatagaatgttctaaacaatcctgcggcctctactctgcattcaattacat

SEQ ID NO: 589 - DNA, 51 bp, Artificial
  Synthetic Oligonucleotide
gatagaatgttctaaactatcctgcggcctctactctgcattcaattacat

SEQ ID NO: 590 - DNA, 51 bp, Artificial
  Synthetic Oligonucleotide
ggtcccacgcggcccacagctgcaccaggaagaagggtgcccagcacagca

SEQ ID NO: 591 - DNA, 51 bp, Artificial
  Synthetic Oligonucleotide
ggggtcccacgcggcccacagctgcaccaggaagaagggtgcccagcacag

SEQ ID NO: 592 - DNA, 51 bp, Artificial
  Synthetic Oligonucleotide
gccgggtcccacgcggcccacagctgcaccaggaagaagggtgcccagcac

SEQ ID NO: 593 - DNA, 51 bp, Artificial
  Synthetic Oligonucleotide
gggtgatgacatcccaggcgatcgtgtggcctccaggagcccagagcagga

SEQ ID NO: 594 - DNA, 51 bp, Artificial
  Synthetic Oligonucleotide
gagggtgatgacatcccaggcgatcgtgtggcctccaggagcccagagcag

SEQ ID NO: 595 - DNA, 51 bp, Artificial
  Synthetic Oligonucleotide
gatcagggtgatgacatcccaggcgatcgtgtggcctccaggagcccagag

SEQ ID NO: 596 - DNA, 51 bp, Artificial
  Synthetic Oligonucleotide
ggtggctccattcactccaatgctgagcacttccacagagtgggttaaagc

SEQ ID NO: 597 - DNA, 51 bp, Artificial
  Synthetic Oligonucleotide
gtttctaatatattttgccagactgatggactattctcaattaataatgat

SEQ ID NO: 598 - DNA, 51 bp, Artificial
  Synthetic Oligonucleotide
gagatgttgctgtggatccagtccacagccagcccgtcgggggcctggatg

SEQ ID NO: 599 - DNA, 51 bp, Artificial
  Synthetic Oligonucleotide
gcaggccggcccagctgccaggtgcacctgctcggagcatcgggccggatc

SEQ ID NO: 600 - DNA, 51 bp, Artificial
  Synthetic Oligonucleotide
gcaaagaacctctgggtccaagggtagaccaccagcagcctgcccagggcc

SEQ ID NO: 601 - DNA, 51 bp, Artificial
  Synthetic Oligonucleotide
gaagagaaacttagtttccagggctttggtagagggcaaaggttgatagca

SEQ ID NO: 602 - DNA, 51 bp, Artificial
  Synthetic Oligonucleotide
gtcagcctagtgcagagccactggtagttggtggttagagtttcaagttcc

SEQ ID NO: 603 - DNA, 51 bp, Artificial
  Synthetic Oligonucleotide
ggctcattgtgaacaggccagtaatgtccgggatggggcggcataggcggg

SEQ ID NO: 604 - DNA, 51 bp, Artificial
  Synthetic Oligonucleotide
gtagctaaagaacttgaccaagacatatcaggatccacctcagctcctaga

SEQ ID NO: 605 - DNA, 51 bp, Artificial
  Synthetic Oligonucleotide
ggggcattgttctgtgcccagtcctgctggtagacctgctccccggtggct

SEQ ID NO: 606 - DNA, 51 bp, Artificial
  Synthetic Oligonucleotide
gagaagtcgttcatgtgccaccgtgggagcgtacagtcatcattgatcttg

SEQ ID NO: 607 - DNA, 51 bp, Artificial
  Synthetic Oligonucleotide
gggattaatgctgaacgcaccaaagttcatcccaccacccatattactacc

SEQ ID NO: 608 - DNA, 51 bp, Artificial
  Synthetic Oligonucleotide
gctccaaaggctttcctccactgttgcaaagttattgaatcccaagacaca

SEQ ID NO: 609 - DNA, 51 bp, Artificial
  Synthetic Oligonucleotide
gatgaatgaacgatttcccagaactccctaatcagaacagagtccctggta

SEQ ID NO: 610 - DNA, 51 bp, Artificial
  Synthetic Oligonucleotide
ggagcctctgccggagcccagagaacccgagagtcagacagagccagcgcc

SEQ ID NO: 611 - DNA, 51 bp, Artificial
  Synthetic Oligonucleotide
ggcttccgtggagacacccaatcaatttgaagagatcttgaagtgatgcca

SEQ ID NO: 612 - DNA, 51 bp, Artificial
  Synthetic Oligonucleotide
gtgggactgccctcctcccatttgcagatgccgtcgtagaatcgcagcagg

SEQ ID NO: 613 - DNA, 51 bp, Artificial
  Synthetic Oligonucleotide
gcttcttcaatagttctccagctacactggcaggcatatgcccgtgttcct

SEQ ID NO: 614 - DNA, 51 bp, Artificial
  Synthetic Oligonucleotide
gattccttttcttcgtcccaattcacctcagtggctagtcgaagaatgaag

SEQ ID NO: 615 - DNA, 51 bp, Artificial
  Synthetic Oligonucleotide
gcagcttcagcaccttccagtcagactcctgcttcaagcactgcagcagga

SEQ ID NO: 616 - DNA, 51 bp, Artificial
  Synthetic Oligonucleotide
gccatttgcttgcagtgccactccagaggattccggattgccataaatact

SEQ ID NO: 617 - DNA, 51 bp, Artificial
  Synthetic Oligonucleotide
gttcaatagttttggtccagtatcgtttacagcccttcttggtagatttca

SEQ ID NO: 618 - DNA, 51 bp, Artificial
  Synthetic Oligonucleotide
ggcaaccgtcttctgaccaaatggcagaacatttgtccccaactttccact

SEQ ID NO: 619 - DNA, 51 bp, Artificial
  Synthetic Oligonucleotide
gcgactttccaatgaaccactgaagcccaggtatgacaaagccgatgatct

SEQ ID NO: 620 - DNA, 51 bp, Artificial
  Synthetic Oligonucleotide
gtttacactcatgcttccacagctttaacagatcatttggttccttgatga

SEQ ID NO: 621 - DNA, 51 bp, Artificial
  Synthetic Oligonucleotide
gcttaagcttccgtgtccagccttcaggcagggtggggtcatcatacatgg

SEQ ID NO: 622 - DNA, 51 bp, Artificial
  Synthetic Oligonucleotide
ggacagctgggctgatccatgatgtcatccagaaacactggggaccctcag

SEQ ID NO: 623 - DNA, 51 bp, Artificial
  Synthetic Oligonucleotide
gtctcatctcaactttccatatccgtatcatggaatcatagcatcctgtaa

SEQ ID NO: 624 - DNA, 51 bp, Artificial
  Synthetic Oligonucleotide
gcatgcagacgcggttccactcgcagccacagttccagcaccactcgagcc

SEQ ID NO: 625 - DNA, 51 bp, Artificial
  Synthetic Oligonucleotide
gttggttagggtcaacccagtattctccactcttgagttcaggatggcaga

SEQ ID NO: 626 - DNA, 51 bp, Artificial
  Synthetic Oligonucleotide
gctacactgtccaacacccactctcgggtcaccacaggtgcctcacacatc

SEQ ID NO: 627 - DNA, 51 bp, Artificial
  Synthetic Oligonucleotide
gctgcactgtgtacccccagagctccgtgttgccgacatcctggggtggct

SEQ ID NO: 628 - DNA, 51 bp, Artificial
  Synthetic Oligonucleotide
gagcttcctgccactcccaacaggtttcacagtaagcgcgtatctgttcca

SEQ ID NO: 629 - DNA, 51 bp, Artificial
  Synthetic Oligonucleotide
gacggcaagagcttacccagtcacttgtgtggagacttaaatacttgcata

SEQ ID NO: 630 - DNA, 51 bp, Artificial; identical to SEQ ID NO: 580
  Synthetic Oligonucleotide

SEQ ID NO: 631 - DNA, 51 bp, Artificial; identical to SEQ ID NO: 581
  Synthetic Oligonucleotide

SEQ ID NO: 632 - DNA, 51 bp, Artificial; identical to SEQ ID NO: 582
  Synthetic Oligonucleotide

SEQ ID NO: 633 - DNA, 51 bp, Artificial; identical to SEQ ID NO: 583
  Synthetic Oligonucleotide

SEQ ID NO: 634 - DNA, 51 bp, Artificial; identical to SEQ ID NO: 584
  Synthetic Oligonucleotide

SEQ ID NO: 635 - DNA, 51 bp, Artificial; identical to SEQ ID NO: 585
  Synthetic Oligonucleotide

SEQ ID NO: 636 - DNA, 51 bp, Artificial; identical to SEQ ID NO: 586
  Synthetic Oligonucleotide

SEQ ID NO: 637 - DNA, 30 bp, Artificial; identical to SEQ ID NO: 574
  Synthetic Oligonucleotide

SEQ ID NO: 638 - DNA, 51 bp, Artificial; identical to SEQ ID NO: 202
  Synthetic Oligonucleotide

SEQ ID NO: 639 - DNA, 34 bp, Artificial
  Synthetic Oligonucleotide
gcagggttttcccagtcacgacgttgtaaagttg

SEQ ID NO: 640 - DNA, 51 bp, Artificial
  Synthetic Oligonucleotide
gtcaaggcactcttgcccacgccaccagctccaactaccacaagtttatat

SEQ ID NO: 641 - DNA, 51 bp, Artificial
  Synthetic Oligonucleotide
gcaaagatcacccggcccacatcttcatctccaattcgtaggtcaaaatac

SEQ ID NO: 642 - DNA, 51 bp, Artificial
  Synthetic Oligonucleotide
gcgccaccagctccaaccaccacaagtttatattcagtcattttcagcagg

SEQ ID NO: 643 - DNA, 51 bp, Artificial
  Synthetic Oligonucleotide
gtttctccatcaattaccacttgcttcctgtaggaatcctctattgttgga

SEQ ID NO: 644 - DNA, 51 bp, Artificial; identical to SEQ ID NO: 582
  Synthetic Oligonucleotide

SEQ ID NO: 645 - DNA, 30 bp, Artificial; identical to SEQ ID NO: 574
  Synthetic Oligonucleotide

SEQ ID NO: 646 - DNA, 83 bp, Artificial
  Synthetic Oligonucleotide
tctttccataggccctgaaaaagggcctgttctaaaccatcctgcggcctctactcggccctgaaaaagggccattcaattac

SEQ ID NO: 647 - DNA, 83 bp, Artificial
  Synthetic Oligonucleotide
cagctggcgaggccctgaaaaagggccggggatgtgccgcaaggcgattaagttggggccctgaaaaagggccacgccagggt

SEQ ID NO: 648 - DNA, 79 bp, Artificial
  Synthetic Oligonucleotide
gtggaatagtataacaatatgctaaatgttgttatagtatcccactctaaaccatcctgcggggccctcttcagggccc

SEQ ID NO: 649 - DNA, 79 bp, Artificial
  Synthetic Oligonucleotide
gtggaatagtataacaatatgctaaatgttgttatagtatcccacaccctggcgttacccagggccctcttcagggccc

SEQ ID NO: 650 - protein, 385 aa, Homo sapiens
QLHLPQVLADAVSRLVLGKFGDLTDNFSSPHARRKVLAGVVMTTGTDVKDAKVISVSTGTKCINGEYMSDRGLALNDCHAEIISRRSLLRFLYTQLELYLNNKDDQKRSIFQKSERGGFRLKENVQFHLYISTSPCGDARIFSPHEPILEEPADRHPNRKARGQLRTKIESGQGTIPVRSNASIQTWDGVLQGERLLTMSCSDKIARWNVVGIQGSLLSIFVEPIYFSSIILGSLYHGDHLSRAMYQRISNIEDLPPLYTLNKPLLSGISNAEARQPGKAPNFSVNWTVGDSAIEVINATTGKDELGRASRLCKHALYCRWMRVHGKVPSHLLRSKITKPNVYHESKLAAKEYQAAKARLFTAFIKAGLGAWVEKPTEQDQFSLT

SEQ ID NO: 651 - protein, 336 aa, Homo sapiens
SLGTGNRCVKGDSLSLKGETVNDCHAEIISRRGFIRFLYSELMKYNSQTAKDSIFEPAKGGEKLQIKKTVSFHLYISTAPCGDGALFDKSCSDRAMESTESRHYPVFENPKQGKLRTKVENGQGTIPVESSDIVPTWDGIRLGERLRTMSCSDKILRWNVLGLQGALLTHFLQPIYLKSVTLGYLFSQGHLTRAICCRVTRDGSAFEDGLRHPFIVNHPKVGRVSIYDSKRQSGKTKETSVNWCLADGYDLEILDGTRGTVDGPRNELSRVSKKNIFLLFKKLCSFRYRRDLLRLSYGEAKKAARDYETAKNYFKKGLKDMGYGNWISKPQEEKNF

SEQ ID NO: 652 - protein, 340 aa, Octopus vulgaris
SVGTGNRCLTGDHLSLEGNSVNDSHAEMITRRGFLRYLYRHLLEYDAEVPNDLFEKGERSICRIKTNITFHLYISTAPCGDGALFSPRDTDSSNAKMEEENKHIHNPTFSSSVQGLLRTKVEGGQGTIPIDADFTEQTWDGIQRGERLRTMSCSDKICRWNVVGLQGALLSHFIEPIYLDSLTLGYLYDHGHLARAVCCRIERGEASVNQLLPEGYRLNHPWLGRVTACDPPRETQKTKSLSINWCYDDEKSEVLDGTAGICYTAIEKNLFSRLTKHNLYEEFKRVCRKFDRNDLLTAPSYNKAKMMATPFQTAKNVMLKKLKENNCGTWVSKPIEEEMF

SEQ ID NO: 653 - protein, 340 aa, Artificial
  Synthetic Oligonucleotide
SVGTGNRCLTGDRLSLEGNSVNDSHAEMVTRRGFLRYLYKHLLEYDPEKPHDLFEKGERSLCRIKTNITFHLYISTAPCGDGALFSPRDTDSSNVKVDEENKHVHNPTFSSSVQGLLRTKVEGGQGTIPIDADFTEQTWDGIQRGERLRTMSCSDKICRWNVVGLQGALLSHFVEPIYLESLTLGYLYDHGHLARAVCCRIERGEASVNQLLPEGYRLNHPWLGRVTACDPPRETQKTKSLSINWCYDDEKSEVLDGTAGICYTAIEKNLFSRLTKHSLYEEFKKVCQKFEREDLLNVTSYNKAKMMAIPFQTAKNVMLKKLKENNCGTWVSKPIEEEMF

SEQ ID NO: 654 - protein, 328 aa, Octopus vulgaris
GIGTGTKCINGEHMSDRGFGVNDCHAEIIARRCFLRYIYDQLELHLSDNSDVRNSSIFELRDKGGYQLKENIQFHLYISTAPCGDARIFSPHGQDVETGDRHPNRKARGQLRTKIESGQGTIPVRTSGVIQTWDGVLEGERLLTMSCSDKIARWNVLGIQGSLLSHFMNPIYLESIILGSLYHSDHLSRAMYSRISIIENLPEPFHLNRPFLSGISSPESRQPGKAPNFGINWRKEDETFEVINAMTGRVEGGSVSRICKQALFGRFMSLYGKLSSLTGQSVTTRPTHYSDAKAAVMEYQLAKQCVFQAFQKAGLGNWVQKPIEQDQF

SEQ ID NO: 655 - protein, 328 aa, Sepia mutant
GIGTGTKCINGEYMNDRGFAVNDCHAEIIARRCFLRFIYDQLEMHLSEDPEVRGQSVFELRDGGGYKLKPNIHFHLYISTAPCGDARIFSPHGQDVETGDRHPNRKARGQLRTKIESGQGTIPVRSSGFIQTWDGVLEGERLLTMSCSDKIARWNVLGIQGALLCHFMHPIYLESIILGSLYHSDHLSRAVYCRIASIENLPDLFQLNRPFLSGISSPESRQPGKAPNFGINWRRNDDTFEVINAMTGRVEGGNMSRICKQALFDRFMNLYGRLSSLTGQSVTTRPTLYSEAKAAVMEYQLAKQCVFQAFQKAGLGNWVQKPIEQDQF

SEQ ID NO: 656 - protein, 328 aa, Doryteusthis opalescens
GIGTGTKCINGEYMNDRGFAVNDCHAEIIARRCFLRFIYDQLELHLSDNAEVRGQSIFELRDAGGYKLKPNIQFHLYISTAPCGDARIFSPHGQDVETGDRHPNRKARGQLRTKIESGQGTIPVRSSGFIQTWDGVLEGERLLTMSCSDKIARWNVLGVQGALLCHFMHPIYLESIILGSLYHSDHLSRAVYCRIAAIENLPDLFRLNRPFLSGISSPESRQPGKAPNFGINWRRNDDSFEVINAMTGRVEGGSMSRICKQALFDRFMNLYGKLSSLTGQSVTTRPALYSEAKATVMEYQLAKQCVFQAFQKAGLGNWVQKPIEQDQF

SEQ ID NO: 657 - DNA, 57 bp, Artificial
  Synthetic Oligonucleotide
gaatgcagagtagaggccgcaggatagtttagaacattctatggaaagagattccag

SEQ ID NO: 658 - DNA, 86 bp, Artificial
  Synthetic Oligonucleotide
ttgccgaatgtgtcagtatgtaattgaatgcagagtagaggccgcaggatagtttagaacattctatggaaagagattccagttcc

SEQ ID NO: 659 - DNA, 86 bp, Artificial
  Synthetic Oligonucleotide
aacggcttacacagtcatacattaacttacgtctcatctccggcgtcctatcaaatcttgtaagatacctttctctaaggtcaagg

SEQ ID NO: 660 - DNA, 51 bp, Artificial
  Synthetic Oligonucleotide
cttacgtctcatctccggcgtcctatcaaatcttgtaagatacctttctct

SEQ ID NO: 661 - RNA, 19 nt, Artificial
  Synthetic Oligonucleotide
augacauggacugauuugc

SEQ ID NO: 662 - RNA, 19 nt, Artificial
  Synthetic Oligonucleotide
uacugcaccggacgaaacg

SEQ ID NO: 663 - DNA, 19 bp, Artificial
  Synthetic Oligonucleotide
  misc_feature (6)..(6): n = inosine
augacnuggacugauuugc

SEQ ID NO: 664 - RNA, 19 nt, Artificial
  Synthetic Oligonucleotide
uacugcaccggacgaaacg

SEQ ID NO: 665 - RNA, 19 nt, Artificial
  Synthetic Oligonucleotide
augacauggacugauuugc

SEQ ID NO: 666 - RNA, 19 nt, Artificial
  Synthetic Oligonucleotide
uacugcaccagacaaaacg

SEQ ID NO: 667 - RNA, 19 nt, Artificial
  Synthetic Oligonucleotide
  misc_feature (6)..(6): n = inosine
augacnuggacugauuugc

SEQ ID NO: 668 - RNA, 19 nt, Artificial
  Synthetic Oligonucleotide
uacugcaccagacaaaacg

SEQ ID NO: 669 - RNA, 19 nt, Artificial
  Synthetic Oligonucleotide
augacauggacugauuugc

SEQ ID NO: 670 - RNA, 19 nt, Artificial
  Synthetic Oligonucleotide
uacugcaccggaccaaacg

SEQ ID NO: 671 - RNA, 19 nt, Artificial
  Synthetic Oligonucleotide
  misc_feature (6)..(6): n = inosine
  misc_feature (14)..(14): n = inosine
augacnuggacugnuuugc

SEQ ID NO: 672 - RNA, 19 nt, Artificial
  Synthetic Oligonucleotide
uacugcaccggaccaaacg

SEQ ID NO: 673 - DNA, 36 bp, Artificial
  Synthetic Oligonucleotide
tggaggtgctcaaagagatggaagccaatgcccgga

SEQ ID NO: 674 - DNA, 36 bp, Artificial
  Synthetic Oligonucleotide
  misc_feature (1)..(1): n = any nucleotide
nggaggtgctcaaagagatggaagccaatgcccgga

SEQ ID NO: 675 - DNA, 36 bp, Artificial
  Synthetic Oligonucleotide
  misc_feature (2)..(2): n = any nucleotide
tngaggtgctcaaagagatggaagccaatgcccgga

SEQ ID NO: 676 - DNA, 36 bp, Artificial
  Synthetic Oligonucleotide
  misc_feature (3)..(3): n = any nucleotide
tgnaggtgctcaaagagatggaagccaatgcccgga

SEQ ID NO: 677 - DNA, 36 bp, Artificial
  Synthetic Oligonucleotide
  misc_feature (4)..(4): n = any nucleotide
tggnggtgctcaaagagatggaagccaatgcccgga

SEQ ID NO: 678 - DNA, 36 bp, Artificial
  Synthetic Oligonucleotide
  misc_feature (4)..(4): n = any nucleotide
  misc_feature (36)..(36): n = any nucleotide
tggnggtgctcaaagagatggaagccaatgcccggn

SEQ ID NO: 679 - DNA, 36 bp, Artificial
  Synthetic Oligonucleotide
  misc_feature (1)..(2): n = any nucleotide
nngaggtgctcaaagagatggaagccaatgcccgga

SEQ ID NO: 680 - DNA, 36 bp, Artificial
  Synthetic Oligonucleotide
  misc_feature (1)..(1): n = any nucleotide
  misc_feature (3)..(3): n = any nucleotide
ngnaggtgctcaaagagatggaagccaatgcccgga

SEQ ID NO: 681 - DNA, 36 bp, Artificial
  Synthetic Oligonucleotide
  misc_feature (1)..(1): n = any nucleotide
  misc_feature (4)..(4): n = any nucleotide
nggnggtgctcaaagagatggaagccaatgcccgga

SEQ ID NO: 682 - DNA, 36 bp, Artificial
  Synthetic Oligonucleotide
  misc_feature (1)..(1): n = any nucleotide
  misc_feature (5)..(5): n = any nucleotide
nggangtgctcaaagagatggaagccaatgcccgga

SEQ ID NO: 683 - DNA, 36 bp, Artificial
  Synthetic Oligonucleotide
  misc_feature (35)..(36): n = any nucleotide
tggaggtgctcaaagagatggaagccaatgcccgnn

SEQ ID NO: 684 - DNA, 34 bp, Artificial
  Synthetic Oligonucleotide
agagatggaagccaatgcccggaaagctggctgc

SEQ ID NO: 685 - DNA, 34 bp, Artificial
  Synthetic Oligonucleotide
  misc_feature (1)..(1): n = any nucleotide
ngagatggaagccaatgcccggaaagctggctgc

SEQ ID NO: 686 - DNA, 34 bp, Artificial
  Synthetic Oligonucleotide
  misc_feature (2)..(2): n = any nucleotide
anagatggaagccaatgcccggaaagctggctgc

SEQ ID NO: 687 - DNA, 34 bp, Artificial
  Synthetic Oligonucleotide
  misc_feature (3)..(3): n = any nucleotide
agngatggaagccaatgcccggaaagctggctgc

SEQ ID NO: 688 - DNA, 34 bp, Artificial
  Synthetic Oligonucleotide
  misc_feature (4)..(4): n = any nucleotide
aganatggaagccaatgcccggaaagctggctgc

SEQ ID NO: 689 - DNA, 34 bp, Artificial
  Synthetic Oligonucleotide
  misc_feature (34)..(34): n = any nucleotide
agagatggaagccaatgcccggaaagctggctgn

SEQ ID NO: 690 - DNA, 34 bp, Artificial
  Synthetic Oligonucleotide
  misc_feature (1)..(2): n = any nucleotide
nnagatggaagccaatgcccggaaagctggctgc

SEQ ID NO: 691 - DNA, 34 bp, Artificial
  Synthetic Oligonucleotide
  misc_feature (1)..(1): n = any nucleotide
  misc_feature (3)..(3): n = any nucleotide
ngngatggaagccaatgcccggaaagctggctgc

SEQ ID NO: 692 - DNA, 34 bp, Artificial
  Synthetic Oligonucleotide
  misc_feature (1)..(1): n = any nucleotide
  misc_feature (4)..(4): n = any nucleotide
nganatggaagccaatgcccggaaagctggctgc

SEQ ID NO: 693 - DNA, 34 bp, Artificial
  Synthetic Oligonucleotide
  misc_feature (1)..(1): n = any nucleotide
  misc_feature (5)..(5): n = any nucleotide
ngagntggaagccaatgcccggaaagctggctgc

SEQ ID NO: 694 - DNA, 34 bp, Artificial
  Synthetic Oligonucleotide
  misc_feature (33)..(34): n = any nucleotide
agagatggaagccaatgcccggaaagctggctnn

SEQ ID NO: 695 - RNA, 55 nt, Cypridinia sp.
aaugcagaguagaggccgcaggauaguuuagaacauucuauggaaagagauucca

SEQ ID NO: 696 - protein, 27 aa, Artificial
  Synthetic Peptide
CRMCQYVIECRVEAAGFRTFYGKRFQF

SEQ ID NO: 697 - DNA, 48 bp, Artificial
  Synthetic Oligonucleotide
cgagcctcacacgtgctgcttgactacagggagacgtgcgctgctccc

SEQ ID NO: 698 - protein, 16 aa, Artificial
  Synthetic Peptide
RASHVLLDYRETCAAP

SEQ ID NO: 699 - DNA, 48 bp, Artificial
  Synthetic Oligonucleotide
cgagcctcacacgtggaaagggactacagggagacgtgcgctgctccc

SEQ ID NO: 700 - RNA, 45 nt, Cypridinia sp.
auugaaugcagaguagaggccgcaggauaguuuagaacauucuau

SEQ ID NO: 701 - RNA, 66 nt, Cypridinia sp.
ucuaaaccauccugcggccucuacucugcaguuguggaagguccaguuuugggggcuauuacaaca

SEQ ID NO: 702 - DNA, 105 bp, Cypridinia sp.
tgccgaaugugucaguauguaauugaaugcagaguagaggccgcaggauaguuuagaacauucuauggaaagagauuccaguuccaggaaccugguacauacgug

SEQ ID NO: 703 - DNA, 48 bp, Artificial
  Synthetic Oligonucleotide
cgagcctcacacaagacccttgactacagggagacgtgcgctgctccc

SEQ ID NO: 704 - RNA, 19 nt, Artificial
  Synthetic Oligonucleotide
uuccccacauugacguuca

SEQ ID NO: 705 - RNA, 65 nt, Artificial
  Synthetic Oligonucleotide
ucgucuaugugcugugcugggcacccuucuuccuggugcagcuguaggccgcgugggacccggag

SEQ ID NO: 706 - RNA, 50 nt, Artificial
  Synthetic Oligonucleotide
gucccacgcggcccacagcugcaccaggaagaagggugcccagcacagca

SEQ ID NO: 707 - RNA, 50 nt, Artificial
  Synthetic Oligonucleotide
gggucccacgcggcccacagcugcaccaggaagaagggugcccagcacag

SEQ ID NO: 708 - RNA, 50 nt, Artificial
  Synthetic Oligonucleotide
ccgggucccacgcggcccacagcugcaccaggaagaagggugcccagcac

SEQ ID NO: 709 - RNA, 65 nt, Artificial
  Synthetic Oligonucleotide
ccucaacuuccugcucugggcuccuggaggccacacgaucgccuaggaugucaucacccugaugg

SEQ ID NO: 710 - RNA, 50 nt, Artificial
  Synthetic Oligonucleotide
ggugaugacaucccaggcgaucguguggccuccaggagcccagagcagga

SEQ ID NO: 711 - RNA, 50 nt, Artificial
  Synthetic Oligonucleotide
agggugaugacaucccaggcgaucguguggccuccaggagcccagagcag

SEQ ID NO: 712 - RNA, 50 nt, Artificial
  Synthetic Oligonucleotide
aucagggugaugacaucccaggcgaucguguggccuccaggagcccagag

SEQ ID NO: 713 - RNA, 99 nt, Artificial
  Synthetic Oligonucleotide
cccaggugcgggagagaggccugcugaaaaugacugaauauaaacuugugguaguuggagcugguggcguaggcaagagugccuugacgauacagcuaa

SEQ ID NO: 714 - RNA, 50 nt, Artificial
  Synthetic Oligonucleotide
caccacaaguuuauauucagucauuuucagcaggccucucucccgcaccu

SEQ ID NO: 715 - RNA, 50 nt, Artificial
  Synthetic Oligonucleotide
gcuccaaccaccacaaguuuauauucagucauuuucagcaggccucucuc

SEQ ID NO: 716 - RNA, 50 nt, Artificial
  Synthetic Oligonucleotide
cgccaccagcuccaaccaccacaaguuuauauucagucauuuucagcagg

SEQ ID NO: 717 - RNA, 50 nt, Artificial
  Synthetic Oligonucleotide
cuugccuacgccaccagcuccaaccaccacaaguuuauauucagucauuu

SEQ ID NO: 718 - RNA, 50 nt, Artificial
  Synthetic Oligonucleotide
aaggcacucuugccuacgccaccagcuccaaccaccacaaguuuauauuc

SEQ ID NO: 719 - RNA, 49 nt, Artificial
  Synthetic Oligonucleotide
guacgucaaggcacucuugccuacgccaccagcuccaaccaccacaagu

SEQ ID NO: 720 - RNA, 50 nt, Artificial
  Synthetic Oligonucleotide
aauuagcuguaucgucaaggcacucuugccuacgccaccagcuccaacca

SEQ ID NO: 721 - DNA, 44 bp, Cypridinia luciferase
tatgtaattgaatgcagagtagaggccgcaggatagtttagaac

SEQ ID NO: 722 - RNA, 39 nt, Artificial
  Synthetic Oligonucleotide
  misc_feature (4)..(5): n = any nucleotide
  misc_feature (36)..(39): n = any nucleotide
augnnuugccaccgacgacaccgugaggauaaauunnnn

SEQ ID NO: 723 - RNA, 36 nt, Artificial
  Synthetic Oligonucleotide
uggaggugcucaaagagauggaagccaaugcccgga

SEQ ID NO: 724 - RNA, 36 nt, Artificial
  Synthetic Oligonucleotide
  misc_feature (1)..(1): n = any nucleotide
nggaggugcucaaagagauggaagccaaugcccgga

SEQ ID NO: 725 - RNA, 36 nt, Artificial
  Synthetic Oligonucleotide
  misc_feature (2)..(2): n = any nucleotide
ungaggugcucaaagagauggaagccaaugcccgga

SEQ ID NO: 726 - RNA, 36 nt, Artificial
  Synthetic Oligonucleotide
  misc_feature (3)..(3): n = any nucleotide
ugnaggugcucaaagagauggaagccaaugcccgga

SEQ ID NO: 727 - RNA, 36 nt, Artificial
  Synthetic Oligonucleotide
  misc_feature (4)..(4): n = any nucleotide
uggnggugcucaaagagauggaagccaaugcccgga

SEQ ID NO: 728 - RNA, 36 nt, Artificial
  Synthetic Oligonucleotide
  misc_feature (18)..(18): n = any nucleotide
uggaggugcucaaagagnuggaagccaaugcccgga

SEQ ID NO: 729 - RNA, 36 nt, Artificial
  Synthetic Oligonucleotide
  misc_feature (36)..(36): n = any nucleotide
uggaggugcucaaagagauggaagccaaugcccggn

SEQ ID NO: 730 - RNA, 36 nt, Artificial
  Synthetic Oligonucleotide
  misc_feature (1)..(2): n = any nucleotide
nngaggugcucaaagagauggaagccaaugcccgga

SEQ ID NO: 731 - RNA, 36 nt, Artificial
  Synthetic Oligonucleotide
  misc_feature (1)..(1): n = any nucleotide
  misc_feature (3)..(3): n = any nucleotide
ngnaggugcucaaagagauggaagccaaugcccgga

SEQ ID NO: 732 - RNA, 36 nt, Artificial
  Synthetic Oligonucleotide
  misc_feature (1)..(1): n = any nucleotide
  misc_feature (4)..(4): n = any nucleotide
nggnggugcucaaagagauggaagccaaugcccgga

SEQ ID NO: 733 - RNA, 36 nt, Artificial
  Synthetic Oligonucleotide
  misc_feature (1)..(1): n = any nucleotide
  misc_feature (5)..(5): n = any nucleotide
nggangugcucaaagagauggaagccaaugcccgga

SEQ ID NO: 734 - RNA, 36 nt, Artificial
  Synthetic Oligonucleotide
  misc_feature (14)..(14): n = any nucleotide
  misc_feature (18)..(18): n = any nucleotide
uggaggugcucaangagnuggaagccaaugcccgga

SEQ ID NO: 735 - RNA, 20 nt, Artificial
  Synthetic Oligonucleotide
aagggguguaaccagcaagu

SEQ ID NO: 736 - RNA, 34 nt, Artificial
  Synthetic Oligonucleotide
agagauggaagccaaugcccggaaagcuggcugc

SEQ ID NO: 737 - RNA, 24 nt, Artificial
  Synthetic Oligonucleotide
  misc_feature (1)..(4): n = any nucleotide
nnnngacuacagucccgaaacuag

SEQ ID NO: 738 - RNA, 19 nt, Artificial
  Synthetic Oligonucleotide
uuccccacauugacguuca

SEQ ID NO: 739 - RNA, 20 nt, Artificial
  Synthetic Oligonucleotide
aagggguguaaccggcaagu

SEQ ID NO: 740 - DNA, 36 bp, Cypridinia sp.
tatgtaattgaatgcagccgcaggatggtttggagc

SEQ ID NO: 741 - DNA, 37 bp, Cypridinia sp.
tatgtaattgaatgcagaccgcaggatagtttagaac

SEQ ID NO: 742 - DNA, 38 bp, Cypridinia sp.
tatgtaattgaatgcagagccgcaggatggtttggaac

SEQ ID NO: 743 - DNA, 38 bp, Cypridinia sp.
tatgtaattgaatgcagagtggaaggatggtttagaac

SEQ ID NO: 744 - DNA, 38 bp, Cypridinia sp.; identical to SEQ ID NO: 743

SEQ ID NO: 745 - DNA, 38 bp, Cypridinia sp.
tgtgtaattgaatgcagagtggaaggatggtttagaac

SEQ ID NO: 746 - RNA, 104 nt, Homo sapiens
uuggucucuucggaaagacuguuccaaaaacaguggauaauuuuguggccuuagcuacaggagagaaaggauuuggcuacaaaaacagcaaauuccaucgugua

SEQ ID NO: 747 - RNA, 50 nt, Artificial
  Synthetic Oligonucleotide
cagagaagccuuucugacaagguuuuugucaccuauuaaaacaccggaac

SEQ ID NO: 748 - RNA, 50 nt, Artificial
  Synthetic Oligonucleotide
ccuuucugacaagguuuuugucaccuauuaaaacaccggaaccgaugucc

SEQ ID NO: 749 - RNA, 50 nt, Artificial
  Synthetic Oligonucleotide
acaagguuuuugucaccuauuaaaacaccggaaccgauguccucucuuuc

SEQ ID NO: 750 - RNA, 50 nt, Artificial
  Synthetic Oligonucleotide
uuugucaccuauuaaaacaccggaaccgauguccucucuuuccuaaaccg

SEQ ID NO: 751 - RNA, 50 nt, Artificial
  Synthetic Oligonucleotide
cuauuaaaacaccggaaccgauguccucucuuuccuaaaccgauguuuuu

SEQ ID NO: 752 - RNA, 50 nt, Artificial
  Synthetic Oligonucleotide
acaccggaaccgauguccucucuuuccuaaaccgauguuuuugucguuua

SEQ ID NO: 753 - RNA, 50 nt, Artificial
  Synthetic Oligonucleotide
accgauguccucucuuuccuaaaccgauguuuuugucguuuaagguagca

SEQ ID NO: 754 - RNA, 56 nt, Artificial
  Synthetic Oligonucleotide
aguauguaauugaaugcagaguagaggccgcaggauaguuuagaacauucuaugga

SEQ ID NO: 755 - RNA, 50 nt, Artificial
  Synthetic Oligonucleotide
  misc_feature (17)..(17): n is a, c, g, or u
auagaauguucuaaacnauccugcggccucuacucugcauucaauuacau

SEQ ID NO: 756 - RNA, 59 nt, Artificial
  Synthetic Oligonucleotide
auguaauugaaugcagaguagaggccgcaggauaguuuagaacauucuauggaaagaga

SEQ ID NO: 757 - RNA, 83 nt, Artificial
  Synthetic Oligonucleotide
ucuuuccauaggcccugaaaaagggccuguucuaaaccauccugcggccucuacucggcccugaaaaagggccauucaauuac

SEQ ID NO: 758 - RNA, 21 nt, Artificial
  Synthetic Oligonucleotide
ggccgcaggauaguuuagaac

SEQ ID NO: 759 - RNA, 55 nt, Artificial
  Synthetic Oligonucleotide
aaauguuguuauaguaucccaccucuaaaccauccugcggggcccuagggcccuu

SEQ ID NO: 760 - RNA, 26 nt, Artificial
  Synthetic Oligonucleotide
accgguggaauaguauaacaauaugc

SEQ ID NO: 761 - protein, 7 aa, Artificial
  Synthetic Peptide
GSGGGGS

SEQ ID NO: 762 - DNA, 38 bp, Artificial
  Synthetic Oligonucleotide
tatgtaattgaatgcagagtggaagggtggtttggaac

SEQ ID NO: 763 - DNA, 38 bp, Artificial
  Synthetic Oligonucleotide
tatgtaattgaatgcagagtagaaggatggtttagaac

SEQ ID NO: 764 - DNA, 39 bp, Artificial
  Synthetic Oligonucleotide
tatgtaattgaatgcagagtagagaggatggtttggaac

SEQ ID NO: 765 - DNA, 39 bp, Artificial
  Synthetic Oligonucleotide
tgtgtaattgaatgcagagtggagaggatggtttagaac

SEQ ID NO: 766 - DNA, 39 bp, Artificial
  Synthetic Oligonucleotide
tatgtaattgaatgcagagtggagaggatggtttagagc

SEQ ID NO: 767 - DNA, 39 bp, Artificial
  Synthetic Oligonucleotide
tatgtaattgaatgcagagtagagaggatggtttagagc

SEQ ID NO: 768 - DNA, 39 bp, Artificial
  Synthetic Oligonucleotide
tatgtaattgaatgcagagtggaggccgcggtttggaac

SEQ ID NO: 769 - DNA, 39 bp, Artificial
  Synthetic Oligonucleotide
tatgtaattgaatgcagagtagagaccgcggtttggagc

SEQ ID NO: 770 - DNA, 39 bp, Artificial
  Synthetic Oligonucleotide
tatgtaattgaatgcagagtggagggcgcagtttggagc

SEQ ID NO: 771 - DNA, 39 bp, Artificial
  Synthetic Oligonucleotide
tatgtaattgaatgcagagtagaggccgcaggttggaac

SEQ ID NO: 772 - DNA, 39 bp, Artificial
  Synthetic Oligonucleotide
tgtgtaattgaatgcagagtggaggccgcaggttagaac

SEQ ID NO: 773 - DNA, 39 bp, Artificial
  Synthetic Oligonucleotide
tatgtaattgaatgcagagtggaggccgcaggttggaac

SEQ ID NO: 774 - DNA, 39 bp, Artificial; identical to SEQ ID NO: 773
  Synthetic Oligonucleotide

SEQ ID NO: 775 - DNA, 38 bp, Artificial
  Synthetic Oligonucleotide
tatgtaattgaatgcagagtagagggcgcaggtggagc

SEQ ID NO: 776 - DNA, 39 bp, Artificial
  Synthetic Oligonucleotide
tatgtaattgaatgcagagtccgcaggatggtttagaac

SEQ ID NO: 777 - DNA, 38 bp, Artificial
  Synthetic Peptide
tatgtaattgaatgcagagtagcaggatagtttagaac

SEQ ID NO: 778 - DNA, 38 bp, Artificial
  Synthetic Oligonucleotide
tatgtaattgaatgcagagtagaaggatagtttagaac

SEQ ID NO: 779 - DNA, 39 bp, Artificial
  Synthetic Oligonucleotide
tatgtaattgaatgcagagtagagaggatggtttagaac

SEQ ID NO: 780 - DNA, 39 bp, Artificial; identical to SEQ ID NO: 779
  Synthetic Oligonucleotide

SEQ ID NO: 781 - DNA, 39 bp, Artificial; identical to SEQ ID NO: 779
  Synthetic Oligonucleotide

SEQ ID NO: 782 - DNA, 39 bp, Artificial
  Synthetic Oligonucleotide
tatgtaattgaatgcagagtagagaggatagtttagaac

SEQ ID NO: 783 - DNA, 38 bp, Artificial
  Synthetic Peptide
tatgtaattgaatgcagagtagaggcatggtttagaac

SEQ ID NO: 784 - DNA, 39 bp, Artificial
  Synthetic Oligonucleotide
tatgtaattgaatgcagagtagaggccatggtttagaac

SEQ ID NO: 785 - DNA, 39 bp, Artificial; identical to SEQ ID NO: 784
  Synthetic Oligonucleotide

SEQ ID NO: 786 - DNA, 38 bp, Artificial
  Synthetic Oligonucleotide
tatgtaattgaatgcagagtagaggcctagtttagaac

SEQ ID NO: 787 - DNA, 38 bp, Artificial
  Synthetic Oligonucleotide
tatgtaattgaatgcagagtagaggcctggtttagaac

SEQ ID NO: 788 - DNA, 40 bp, Artificial
  Synthetic Oligonucleotide
tatgtaattgaatgcagagtagagggccgcagtttagaac

SEQ ID NO: 789 - DNA, 39 bp, Artificial
  Synthetic Oligonucleotide
tatgtaattgaatgcagagtagaggccgcaggttagaac

SEQ ID NO: 790 - DNA, 39 bp, Artificial
  Synthetic Oligonucleotide
tatgtaattgaatgcagagtagaggccgcaccttagaac

SEQ ID NO: 791 - DNA, 37 bp, Artificial
  Synthetic Oligonucleotide
taattgaatgcagagtagaggccgcaggatggtttag

SEQ ID NO: 792 - DNA, 37 bp, Artificial
  Synthetic Oligonucleotide
attgaatgcagagtagaggccgcaggatgctttagaa

SEQ ID NO: 793 - RNA, 106 nt, Cypridinia sp.
gccgaaugugucaguauguaauugaaugcagaguagaggccgcaggauaguuuagaacauucuauggaaagagauuccaguuccaggaaccugguacauacguguu

SEQ ID NO: 794 - RNA, 30 nt, Artificial
  Synthetic Oligonucleotide
uuaacuuacgucucaucuccggcguccuac

SEQ ID NO: 795 - RNA, 30 nt, Artificial
  Synthetic Oligonucleotide
cuuacgucucaucuccggcguccuaccaaa

SEQ ID NO: 796 - RNA, 30 nt, Artificial
  Synthetic Oligonucleotide
cgucucaucuccggcguccuaccaaaucuu

SEQ ID NO: 797 - RNA, 30 nt, Artificial
  Synthetic Oligonucleotide
ucaucuccggcguccuaccaaaucuuguaa

SEQ ID NO: 798 - RNA, 30 nt, Artificial
  Synthetic Oligonucleotide
cuccggcguccuaccaaaucuuguaagaua

SEQ ID NO: 799 - RNA, 30 nt, Artificial
  Synthetic Oligonucleotide
ggcguccuaccaaaucuuguaagauaccuu

SEQ ID NO: 800 - RNA, 30 nt, Artificial
  Synthetic Oligonucleotide
uccuaccaaaucuuguaagauaccuuucuc

SEQ ID NO: 801 - RNA, 30 nt, Artificial
  Synthetic Oligonucleotide
accaaaucuuguaagauaccuuucucuaag

SEQ ID NO: 802 - protein, 15 aa, Artificial
  Synthetic Peptide
GGGGSGGGGSGGGGS

SEQ ID NO: 803 - protein, 5 aa, Artificial
  Synthetic Peptide
EAAAK

SEQ ID NO: 804 - protein, 18 aa, Artificial
  Synthetic Peptide
GGSGGSGGSGGSGGSGGS

SEQ ID NO: 805 - protein, 16 aa, Artificial
  Synthetic Peptide
SGSETPGTSESATPES

What is claimed is:

1. An engineered composition for site directed base editing comprising:
   a) a targeting domain; and
   b) an adenosine deaminase or catalytic domain thereof, wherein the adenosine deaminase is modified to convert activity to a cytidine deaminase, wherein the adenosine deaminase or catalytic domain thereof comprises one or more mutations selected from P462A, N597I, or both of a human ADAR2 or mutations corresponding thereto in a homologue, ortholog, or variant thereof.

2. The composition of claim 1, wherein the adenosine deaminase further comprises one or more mutations
at one or more positions selected from E396, C451, V351, R455, T375, K376, S486, Q488, R510, K594, R348, G593, S397, H443, L444, Y445, F442, E438, T448, A353, V355, T339, P539, V525 and I520 of a human ADAR2 or in positions corresponding thereto in a homologue, ortholog, or variant thereof;
at one or more positions selected from E488, V351, S486, T375, and S370 of a human ADAR2 or in positions corresponding thereto in a homologue, ortholog, or variant thereof, or
selected from E488Q, V351G, S486A, T375S, and S370C of a human ADAR2 or mutations corresponding thereto in a homologue, ortholog, or variant thereof.

3. The composition of claim 1, wherein the adenosine deaminase or catalytic domain thereof is a human, cephalopod, or *Drosophila* adenosine deaminase or catalytic domain thereof, or is covalently or non-covalently linked to the targeting domain.

4. The composition of claim 1, wherein said adenosine deaminase or catalytic domain thereof has been modified to comprise a mutation at glutamic acid$^{488}$ of a hADAR2-D amino acid sequence, or a corresponding position in a homologous ADAR protein.

5. The composition of claim 4, wherein said glutamic acid$^{488}$ or a corresponding position in a homologous ADAR protein is replaced by a glutamine residue (E488Q); or said adenosine deaminase or catalytic domain thereof is a mutated hADAR2d comprising mutation E488Q or a mutated hADAR1d comprising mutation E1008Q.

6. The composition of claim 1, wherein the targeting domain is a catalytically inactive Cas13 protein, or a nucleotide sequence encoding said catalytically inactive Cas13 protein.

7. The composition of claim 6, wherein the catalytically inactive Cas13 protein is catalytically inactive Cas13a, catalytically inactive Cas13b, or catalytically inactive Cas13c; is obtained from a Cas13 nuclease derived from a bacterial species selected from the group consisting of *Leptotrichia shahii, L wadei, L wadei* F0279, *Listeria seeligeri*, Lachnospiraceae bacterium MA2020, Lachnospiraceae bacterium NK4A179, [*Clostridium*] *aminophilum* DSM 10710, *Carnobacterium gallinarum* DSM 4847, *Paludibacter propionicigenes* WB4, *Listeria weihenstephanensis* FSL R9-0317, Listeriaceae bacterium FSL M6-0635, *Leptotrichia wadei* F0279, *Rhodobacter capsulatus* SB 1003, *Rhodobacter capsulatus* R121, *Rhodobacter capsulatus* DE442, *Leptotrichia buccalis* C-1013-b, Herbinix hemicellulosilytica, [*Eubacterium*] *rectale*, Eubacteriaceae bacterium CHKCI004, *Blautia* sp. Marseille-P2398, *Leptotrichia* sp. oral taxon 879 str. F0557, Lachnospiraceae bacterium NK4A144, *Chloroflexus aggregans, Demequina aurantiaca, Thalassospira* sp. TSL5-1, SAMN04487830_13920 [*Pseudobutyrivibrio* sp. OR37], SAMN02910398_00008 [*Butyrivibrio* sp. YAB3001], *Leptotrichia* sp. Marseille-P3007, *Bacteroides ihuae*, SAMN05216357_1045 [Porphyromonadaceae bacterium KH3CP3RA], *Listeria riparia, Insolitispirillum peregrinum, Bergeyella zoohelcum, Prevotella intermedia, Prevotella buccae, Porphyromonas gingivalis, Alistipes* sp. ZOR0009, *Bacteroides pyogenes, Prevotella* sp. MA2016, *Riemerella anatipestifer, Prevotella aurantiaca, Prevotella saccharolytica*, HMPREF9712_03108 [*Myroides odoratimimus* CCUG 10230], *Capnocytophaga canimorsus, Porphyromonas gulae, Prevotella* sp. P5-125, *Flavobacterium branchiophilum, Myroides odoratimimus, Flavobacterium columnare, Porphyromonas* sp. COT-052 OH4946, PIN17_0200 [*Prevotella intermedia* 17], HMPREF6485_0083 [*Prevotella buccae* ATCC 33574], HMPREF9144_1146 [*Prevotella pallens* ATCC 700821], HMPREF9714_02132 [*Myroides odoratimimus* CCUG 12901], HMPREF9711_00870 [*Myroides odoratimimus* CCUG 3837], HMPREF9699_02005 [*Bergeyella zoohelcum* ATCC 43767], HMPREF9151_01387 [*Prevotella saccharolytica* F0055], A343_1752 [*Porphyromonas gingivalis* JCVI SC001], HMPREF1981_03090 [*Bacteroides pyogenes* F0041], HMPREF1553_02065 [*Porphyromonas gingivalis* F0568], HMPREF1988_01768 [*Porphyromonas gingivalis* F0185], HMPREF1990_01800 [*Porphyromonas gingivalis* W4087], M573_117042 [*Prevotella intermedia* ZT], A2033_10205 [Bacteroidetes bacterium GWA2_31_9], SAMN05421542_0666 [*Chryseobacterium jejuense*], SAMN05444360_11366 [*Chryseobacterium carnipullorum*], SAMN05421786_1011119, *Prevotella pallens*, [*Chryseobacterium ureilyticum*], *Prevotella* sp. MSX73, *Paludibacter propionicigenes, Psychroflexus torquis, Prevotella pleuritidis, Prevotella falsenii, Capnocytophaga cynodegmi, Prevotella* sp. P5-119, *Prevotella* sp. P4-76, *Prevotella* sp. P5-60, *Phaeodactylibacter xiamenensis, Flavobacterium* sp. 316, *Sinomicrobium oceani, Chryseobacterium* sp. YR477, *Reichenbachiella agariperforans, Fusobacterium necrophorum, Fusobacterium necrophorum* subsp. *funduliforme, Fusobacterium necrophorum* subsp. *funduliforme* ATCC 51357, *Fusobacterium necrophorum* DJ-2, *Fusobacterium necrophorum* BFTR-1, *Fusobacterium necrophorum* subsp. *funduliforme* 1_1_36S, *Fusobacterium perfoetens* ATCC 29250, *Fusobacterium ulcerans* ATCC 49185, *Anaerosalibacter* sp. ND1, or *Anaerosalibacter massiliensis* ND1; or is a Cas13 protein having a sequence of any one of SEQ ID NO: 34-161.

8. An engineered, non-naturally occurring system for modifying an cytosine in a target locus of interest, comprising the composition of claim 6 and
c) a guide molecule which comprises a guide sequence linked to a direct repeat sequence, or a nucleotide sequence encoding said guide molecule;
wherein said adenosine deaminase or catalytic domain thereof is covalently or non-covalently linked to said catalytically inactive Cas13 protein or said guide molecule or is adapted to link thereto after delivery; and
wherein said guide sequence is capable of hybridizing with a target RNA sequence in a target RNA comprising an cytosine to form an RNA duplex, wherein said guide sequence comprises a non-pairing adenosine or uracil at a position corresponding to said cytosine resulting in an C-A/U mismatch in the RNA duplex formed.

9. The composition of claim 1, further comprising a guide molecule which comprises a guide sequence linked to a direct repeat sequence, or a nucleotide sequence encoding said guide molecule.

10. An engineered, non-naturally occurring vector system for modifying a cytosine in a target locus of interest, comprising one or more polynucleotides comprising encoding sequences of a), and b) of claim 1.

11. The engineered, non-naturally occurring vector system of claim 10, comprising one or more vectors comprising:
i) a first regulatory element operably linked to a nucleotide sequence encoding a guide molecule which comprises a guide sequence,
ii) a second regulatory element operably linked to a nucleotide sequence encoding a catalytically inactive Cas13 protein, and
iii) a nucleotide sequence encoding the adenosine deaminase protein or catalytic domain thereof which is under control of said first regulatory element or said second regulatory element or operably linked to a third regulatory element;
wherein, if said nucleotide sequence encoding said adenosine deaminase protein or catalytic domain thereof is operably linked to a third regulatory element, said adenosine deaminase protein or catalytic domain thereof is adapted to link to said guide molecule or said catalytically inactive Cas13 protein after expression;
wherein components (i), (ii), and (iii) are located on the same or on different vectors of the system.

12. A method of modifying an cytosine in a target RNA sequence of interest, comprising delivering to said target RNA the system of claim 8
wherein said adenosine deaminase or catalytic domain thereof deaminates said cytosine in said RNA duplex.

13. The method of claim 12, wherein said adenosine deaminase or catalytic domain thereof is fused to N- or C-terminus of said catalytically inactive Cas13 protein.

14. The method of claim 13, wherein said adenosine deaminase or catalytic domain thereof is fused to said catalytically inactive Cas13 protein by a linker.

15. The method of claim 14, wherein said linker is (GGGGS)$_{3-11}$ (SEQ ID Nos: 1-9), GSG$_5$ (SEQ ID No: 10) or LEPGEKPYKCPECGKSFSQSGALTRHQRTHTR (SEQ ID No: 11), or wherein said linker is an XTEN linker.

16. The method of claim 12, wherein said adenosine deaminase or catalytic domain thereof is linked to an adaptor protein and said guide molecule or said catalytically inactive Cas13 protein comprises an aptamer sequence capable of binding to said adaptor protein.

17. The method of claim 16, wherein said adaptor protein is selected from the group consisting of MS2, PP7, Qβ, F2, GA, fr, JP501, M12, R17, BZ13, JP34, JP500, KU1, M11, MX1, TW18, VK, SP, FI, ID2, NL95, TW19, AP205, φCb5, φCb8r, φCb12r, φCb23r, 7s, and PRR1.

18. The method of claim 17, wherein said adenosine deaminase or catalytic domain thereof is inserted into an internal loop of said catalytically inactive Cas13 protein.

19. The method of claim 18, wherein said catalytically inactive Cas13 protein is:
   a catalytically inactive Cas13a protein comprising two HEPN domains and said catalytically inactive Cas13a protein comprises one or more mutations in the two HEPN domains;
   a catalytically inactive Cas13b protein and said catalytically inactive Cas13b protein comprises a mutation in one or more of positions R116, H121, R1177, or H1182 of a Cas13b protein originating from *Bergeyella zoohelcum* ATCC 43767 or amino acid positions corresponding thereto of a Cas13b ortholog; or
   a catalytically inactive Cas13b protein and said catalytically inactive Cas13b protein comprises one or more mutations R116A, H121A, R1177A, or H1182A of a Cas13b protein originating from *Bergeyella zoohelcum* ATCC 43767 or amino acid positions corresponding thereto of a Cas13b ortholog.

20. The method of claim 19, wherein the one or more mutations in the two HEPN domains comprise of position R474 and R1046 of a Cas 13a protein originating from *Leptotrichia wadei* or amino acid positions corresponding thereto of a Cas13a protein ortholog.

21. The method of claim 12, wherein said guide sequence has a length of from about 20 to about 53 nt, from about 25 to about 53 nt, from about 29 to about 53 nt, or from about 40 to about 50 nt and is capable of forming said RNA duplex with said target RNA sequence of interest.

22. The method of claim 12, wherein
   a distance between a non-pairing A/U and the 5' end of said guide sequence is 20-30 nucleotides;
   the guide sequence comprises more than one mismatch corresponding to different cytosine sites in the target RNA sequence of interest or wherein two guide molecules are used, each comprising a mismatch corresponding to a different cytosine sites in the target RNA sequence of interest;
   said catalytically inactive Cas13 protein comprise one or more heterologous nuclear localization signal(s) (NLS(s)); or
   said method comprises, determining said target RNA sequence of interest and selecting said adenosine deaminase or catalytic domain thereof which most efficiently deaminates said cytosine present in said target RNA sequence of interest.

23. The method of claim 22, wherein said adenosine deaminase or catalytic domain thereof comprise one or more heterologous nuclear localization signal(s) (NLS(s)).

24. The method of claim 12, wherein said target RNA sequence of interest is within a cell.

25. The method of claim 24, wherein said cell is a eukaryotic cell, a non-human animal cell, a human cell, a plant cell, an animal, a plant, or is comprises in a polynucleotide in vitro.

26. The method of claim 12, wherein said components (a), (b) and (c) are delivered to a cell as a ribonucleoprotein complex or one or more polynucleotide molecules.

27. The method of claim 26, wherein said one or more polynucleotide molecules:
   comprise one or more mRNA molecules encoding components (a) and/or (c);
   are comprised within one or more vectors; or
   comprise one or more regulatory elements operably configured to express said catalytically inactive Cas13 protein, said guide molecule, and said adenosine deaminase or catalytic domain thereof.

28. The method of claim 27, wherein said one or more regulatory elements comprise inducible promoters.

29. The method of claim 26, wherein said one or more polynucleotide molecules or said ribonucleoprotein complex are delivered via particles, vesicles, or one or more viral vectors.

30. The method of claim 29, wherein
   said particles comprise a lipid, a sugar, a metal or a protein;
   said particles comprise lipid nanoparticles;
   said vesicles comprise exosomes or liposomes; or
   said one or more viral vectors comprise one or more of adenovirus, one or more lentivirus or one or more adeno-associated virus.

31. The method of claim 12, where said method modifies a cell, a cell line or an organism by manipulation of one or more target RNA sequences.

32. The method of claim 31, wherein said deamination of said cytosine in said target RNA sequence of interest remedies a disease caused by transcripts containing a pathogenic T→C, or A→C point mutation.

33. The method of claim 31, wherein
   said modification affects fertility of an organism;
   said modification affects splicing of said target RNA sequence of interest;
   said modification introduces a mutation in a transcript introducing an amino acid change and causing expression of a new antigen in a cancer cell; or
   said target RNA sequence of interest is comprised within a microRNA;
   said deamination of said cytidine in said target RNA sequence of interest causes a gain of function or a loss of function of a gene; or
   said deamination of said cytidine in said target RNA sequence of interest causes a gain of function or a loss of function of a gene expressed by a cancer cell.

34. The method of claim 12, wherein
   said catalytically inactive Cas13 protein is truncated; or
   said adenosine deaminase or catalytic domain thereof has been modified further to comprise one or more additional mutation of the ADAR.

35. The method of claim 34, wherein the ADAR is a huADAR.

36. The method of claim 35, wherein the huADAR is (hu)ADAR1 or (hu)ADAR2.

37. The method of claim 34, wherein the Cas13 protein is a catalytically inactive Cas13b protein, C-terminally truncated, or a catalytically inactive Cas 13 and is a truncated functional variant of a corresponding wild type Cas13;
- the one or more additional mutation is selected from the group consisting of: R348E, V351L, T375S, T375G, R455E, R455S, R455G, N473D, R474E, K475Q, R477E, R481E, S486T, T490S, S495T, R510E, T490A, R348E, and E488Q, or a corresponding mutation in an ADAR homologue or ortholog;
- or a combination thereof.

* * * * *